US009765355B2

(12) United States Patent
Zhou et al.

(10) Patent No.: US 9,765,355 B2
(45) Date of Patent: Sep. 19, 2017

(54) NUCLEOTIDE SEQUENCES AND CORRESPONDING POLYPEPTIDES CONFERRING MODULATED GROWTH RATE AND BIOMASS IN PLANTS GROWN IN SALINE AND OXIDATIVE CONDITIONS

(75) Inventors: Fasong Zhou, Oxnard, CA (US); Kenneth A. Feldmann, Tucson, AZ (US); Julissa Sosa, Northridge, CA (US)

(73) Assignee: Ceres, Inc., Thousand Oaks, CA (US)

(*) Notice: Subject to any disclaimer, the term of this patent is extended or adjusted under 35 U.S.C. 154(b) by 957 days.

(21) Appl. No.: 13/465,841

(22) Filed: May 7, 2012

(65) Prior Publication Data

US 2012/0227123 A1    Sep. 6, 2012

Related U.S. Application Data

(60) Division of application No. 11/858,117, filed on Sep. 19, 2007, now abandoned, which is a continuation-in-part of application No. PCT/US2007/006544, filed on Mar. 14, 2007.

(60) Provisional application No. 60/782,735, filed on Mar. 14, 2006.

(51) Int. Cl.
*A01H 5/00* (2006.01)
*C12N 15/82* (2006.01)
*C07K 14/415* (2006.01)

(52) U.S. Cl.
CPC ........ *C12N 15/8273* (2013.01); *C07K 14/415* (2013.01); *C12N 15/8271* (2013.01)

(58) Field of Classification Search
None
See application file for complete search history.

(56) References Cited

U.S. PATENT DOCUMENTS

| 6,281,411 | B1 | 8/2001 | Adams et al. | |
|---|---|---|---|---|
| 6,867,351 | B2 | 3/2005 | da Costa e Silva et al. | |
| 2004/0034888 | A1* | 2/2004 | Liu et al. | 800/289 |
| 2006/0150283 | A1* | 7/2006 | Alexandrov et al. | 800/288 |
| 2007/0214517 | A1* | 9/2007 | Alexandrov et al. | 800/278 |
| 2013/0042367 | A1* | 2/2013 | Nadzan et al. | 800/260 |

FOREIGN PATENT DOCUMENTS

| WO | WO-99/61616 A2 | 12/1999 |
|---|---|---|
| WO | WO 0155433 A2 * | 8/2001 |
| WO | WO-2004/092326 A2 | 10/2004 |
| WO | WO-2004/092326 A3 | 10/2004 |
| WO | WO-2006/026756 A2 | 3/2006 |

OTHER PUBLICATIONS

Rhoads et al. (The FASEB Journal, 11:331-340, 1997).*
Kang et al. (Cell death and differentiation, 13:84-95, 2006).*
Wells, Biochemistry 29:8509-8517, 1990.*
Guo et al. (PNAS, 101: 9205-9210, 2004).*
Keskin et al. (Protein Science, 13:1043-1055, 2004).*
Thornton et al. (Nature structural Biology, structural genomics supplement, Nov. 2000).*
Doerks et al., (TIG, 14:248-250, 1998).*
Smith et al. (Nature Biotechnology, 15:1222-1223, 1997).*
Bork et al. (TIG, 12:425-427, 1996).*
Aroca R. et al., 2005, "The role of aquaporins and membrane damage in chilling and hydrogen peroxide induced changes in the hydraulic conductance of maize roots", Plant Physiol. 137(1):341-53. Epub Dec. 10, 2004.
Aviv DH. et al., 2002, "Runaway cell death, but not basal disease resistance, in Isd1 is SA-and NIM1/NPR1-dependent", Plant J. 29(3):381-91.
Borsani O. et al., "Evidence for the role of salicylic acid in the oxidative damage generated by NaCl and osmotic stress in *Arabidopsis* seedlings". Plant Physiol. vol. 126, pp. 1024-1030, 2001.
Brisson L.F. et al. "Function of Oxidative Cross-Linking of Cell Wall Structural Proteins in Plant Disease Resistance," Plant Cell vol. 6, No. 12, pp. 1703-1712, 1994.
Cao H. et al., "Characterization of an *Arabidopsis* mutant that is nonresponsive to inducers of systemic acquired-resistance," Plant Cell vol. 6, pp. 1583-1592, 1994.
Dat J.F. et al., "Changes in salicylic acid and antioxidants during induced thermotolerance in mustard seedlings," Plant Physiol. vol. 118, pp. 1455-1461, 1998.
Delaney T.P. et al., "A central role of salicylic acid in plant-disease resistance," Science vol. 266, pp. 1247-1250, 1994.
Kim H.S. et al., "Effects of salicylic acid on paraquat tolerance in *Arabidopsis thaliana* plants," J. Plant Biol. vol. 46, pp. 31-37, 2003.
Lamb C. et al., "The oxidative burst in plant disease resistance," Annu Rev Plant Physiol Plant Mol Biol. Jun. 1997; vol. 48, pp. 251-275.
Larkindale J. et al. "Protection against heat stress-induced oxidative damage in *Arabidopsis* involves calcium, abscisic acid, ethylene, and salicylic acid," Plant Physiol, vol. 128, pp. 682-695, 2002.
Lee S.H. et al., "Rapid accumulation of hydrogen peroxide in cucumber roots due to exposure to low temperature appears to mediate decreases in water transport," J. Exp. Bot. vol. 55, No. 403, pp. 1733-1741. Epub Jun. 18, 2004.
Levine A. et al., 1994, "H2O2 from the oxidative burst orchestrates the plant hypersensitive disease resistance response," Cell. 18;79(4):pp. 583-593.
Luna C.M. et al., 2005, "Drought controls on H2O2 accumulation, catalase (CAT) activity and CAT gene expression in wheat," J Exp Bot. vol. 56, No. 411, pp. 417-423. Epub Nov. 29, 2004.
Martinez C. et al., 2004, "Salicylic acid regulates flowering time and links defence responses and reproductive development," Plant J. vol. 37, pp. 209-217.

(Continued)

*Primary Examiner* — Vinod Kumar
(74) *Attorney, Agent, or Firm* — Dentons US LLP

(57) ABSTRACT

The present invention relates to isolated nucleic acid molecules and their corresponding encoded polypeptides able confer the trait of improved plant size, vegetative growth, growth rate, seedling vigor and/or biomass in plants challenged with saline and/or oxidative stress conditions. The present invention further relates to the use of these nucleic acid molecules and polypeptides in making transgenic plants, plant cells, plant materials or seeds of a plant having plant size, vegetative growth, growth rate, seedling vigor and/or biomass that are improved in saline and/or oxidative stress conditions with respect to wild-type plants grown under similar conditions.

7 Claims, 18 Drawing Sheets

(56) References Cited

OTHER PUBLICATIONS

Noctor G. et al., 2002, "Drought and oxidative load in the leaves of C3 plants: a predominant role for photorespiration?" Ann Bot (Lond). 89 Spec No. 841-50.
Rusterucci C. et al., 2001, "The disease resistance signaling components EDS1 and PAD4 are essential regulators of the cell death pathway controlled by LSD1 in *Arabidopsis*," Plant Cell. 13(10):2211-2224.
Scott I.M. et al., 2004, "Salicylate accumulation inhibits growth at chilling temperature in *Arabidopsis*," Plant Physiol. 135:1040-1049.
Senaratna T. et al., 2000, "Acetyl salicylic acid (Aspirin) and salicylic acid induce multiple stress tolerance in bean and tomato plants," Plant Growth Regul. 30:157-161.
Surplus S.L. et al., 1998, "Ultraviolet-B-induced responses in *Arabidopsis thaliana*: role of salicylic acid and reactive oxygen species in the regulation of transcripts encoding photosynthetic and acidic pathogenesis-related proteins," Plant Cell Environ 21:685-694.
Zhou F. et al., 2004, "High humidity suppresses ssi4-mediated cell death and disease resistance upstream of MAP kinase activation, $H_2O_2$ production and defense gene expression," Plant J. 39(6):920-32.
Zhou F. et al., 2000, "Proton extrusion is an essential signalling component in the HR of epidermal single cells in the barley-powdery mildew interaction," Plant J. 23(2):245-54.
Smith et al., (Nature Biotechnology, 15:1222-1223, 1997).
Bork et al., (TIG, 12:425-427, 1996).
Kang et al., (Cell death and differentiation, 13:84-95, 2006).
Rhoads et al., (The FASEB Journal, 11:331-340, 1997).
Guo et al., (PNAS, 101:9205-9210, 2004).
Keskin et al., (Protein Science, 13:1043-1055, 2004).
Thornton et al., (Nature structural Biology, structural genomics supplement, Nov. 2000).
Ngo et al., (The Protein Folder Problem and Tertiary Structure Prediction, K. Merz., and S. Le Grand (eds.) pp. 492-495, 1994).
NCBI GenBank Accession No. NP_179785 (Aug. 21, 2001).
NCBI GenBank Accession No. NP_565906 (Jan. 29, 2002).
NCBI GenBank Accession No. NP_565305 (Jan. 29, 2002).
NCBI GenBank Accession No. NP_567957 (Jan. 30, 2002).
NCBI GenBank Accession No. NP_566785 (Jan. 29, 2002).
NCBI GenBank Accession No. NP_567754 (Jan. 29, 2002).
NCBI GenBank Accession No. NM_129505 (Aug. 21, 2001).
NCBI GenBank Accession No. NM_119581 (Jan. 30, 2002).
NCBI GenBank Accession No. BT018295 (Oct. 27, 2004).
NCBI GenBank Accession No. NM_127763 (Nov. 4, 2005).
NCBI GenBank Accession No. BT003928 (Feb. 14, 2003).
NCBI GenBank Accession No. AY086786 (Jan. 27, 2006).
NCBI GenBank Accession No. AY092961 (Apr. 21, 2002).
NCBI GenBank Accession No. AF410323 (Aug. 27, 2001).

* cited by examiner

| | | | | | |
|---|---|---|---|---|---|
| SEQ ID NO:85 | KHEAVMKRER | ALAMAFNYPQ | | WRNDFG | 175 |
| SEQ ID NO:98 | LHSPRHAGG- | YSPDFNEGDD | WRLPFLDGHG | | 253 |
| SEQ ID NO:100 | LPETLXXPSD | TTAEGV | | | 309 |
| SEQ ID NO:68 | LERQSNYPS- | CRTESLGGEP- | | | 310 |
| SEQ ID NO:96 | SEQRSTVSS- | SCAESLGGEP | MSPSSTTD | LRRWLR | 355 |
| SEQ ID NO:95 | SEQRSTVSS- | SCAESVGGEP | ASPSSTTD | LRRWLR | 361 |
| SEQ ID NO:93 | SEQRSNVSS- | SCAESLGGDV | VSPSSTTD | LRRWLR | 373 |
| SEQ ID NO:107 | | | VSPSSTTD | LRRWLR | 291 |

| | | |
|---|---|---|
| SEQ ID NO: 42 | FNRFA————————— | 517 |
| SEQ ID NO: 47 | FGSEAALHQM QMEHYTPIR | 478 |
| SEQ ID NO: 44 | CSLPNWDRDA FFK—————— | 460 |
| SEQ ID NO: 54 | ————————— ————————— | 384 |
| SEQ ID NO: 43 | ————————— ————————— | 383 |
| SEQ ID NO: 41 | YTSFFSSNPL FFQ—————— | 252 |
| SEQ ID NO: 45 | HSSFLV———— ————————— | 403 |
| SEQ ID NO: 50 | Y————————— ————————— | 477 |
| SEQ ID NO: 69 | ————————— ————————— | 464 |
| SEQ ID NO: 65 | ————————— ————————— | 457 |
| SEQ ID NO: 68 | ————————— ————————— | 455 |

| SEQ-ID-NO-136 | MGKRKKWFSS | VKKAFSP | | DSKKSKCKLA | EEQNGVISNP | 37 |
|---|---|---|---|---|---|---|
| SEQ-ID-NO-141 | MGKKGKWFSA | VKKVFSP | | | | 17 |
| SEQ-ID-NO-147 | | | | | | 0 |
| SEQ-ID-NO-145 | MGKKGNWFSA | VKKVFSSSDP | DGREAKIEKA | DKSRSRRKWP | FCKSKKSDPW | 50 |
| SEQ-ID-NO-138 | MGKRGKWFSA | VKKVFSSSDP | DGKEAKAQKA | DKSKSKRRWP | FCKSKHSEPS | 50 |
| SEQ-ID-NO-149 | | | | | | 0 |
| SEQ-ID-NO-151 | MGKKGGRLS | VKKALSP | ESKKSQH | CTPKPKKKW- | FCKSKNLSPV | 43 |

| SEQ-ID-NO-136 | PVVDNVROSS | SSPPP | ALAPR | EVRVAEVIVE | RNPDLSPPSI | 77 |
|---|---|---|---|---|---|---|
| SEQ-ID-NO-141 | | | | | | 17 |
| SEQ-ID-NO-147 | | | | | | 0 |
| SEQ-ID-NO-145 | TSTVAVPTST | APPPQPPPPP | PTHPICPQPE | EIKLVKAVET | DSEQNKHAYS | 100 |
| SEQ-ID-NO-138 | ISTVPGTAPA | VAPLPSPPAT | QPHSL | EIKDVNPVET | DSEQNKHAYS | 95 |
| SEQ-ID-NO-149 | | | | | | 0 |
| SEQ-ID-NO-151 | SV | P | EETEV | ITEDAKLKEA | ENEGSKHAYS | 71 |

| SEQ-ID-NO-136 | ADAVNVTSTD | XPVVPSSSAP | GVYRRATPTR | FAGK | SN EEAEA L QT | 123 |
|---|---|---|---|---|---|---|
| SEQ-ID-NO-141 | | | | | | 17 |
| SEQ-ID-NO-147 | | | | | MS RELAATKIQT | 12 |
| SEQ-ID-NO-145 | VALASAVEKE | AAAVARQEAR | EVVRLTTATT | AVPKSPVSSK | DELAATKIQT | 150 |
| SEQ-ID-NO-138 | VALASAVEKE | AAAVARQAAR | EVVRLTAVTT | AAPKMPVSSR | EELAATKIQT | 145 |
| SEQ-ID-NO-149 | | | | | | 0 |
| SEQ-ID-NO-151 | VALATAVEKE | AAVAARQEAR | EVVRLTSQPR | HLGK | SK EEIAA RIQT | 117 |

| SEQ-ID-NO-136 | IFRGYLARRA | LRAURGLVRL | KLLMECSMVK | RQAANTLKCM | QTLSRVQSQI | 173 |
|---|---|---|---|---|---|---|
| SEQ-ID-NO-141 | | | | | | 17 |
| SEQ-ID-NO-147 | AFRGHLARRA | LRALKGLVRL | KSLVQGHSVK | RQATSTLRCM | QTLSRVQSKI | 62 |
| SEQ-ID-NO-145 | AFRGYLARRA | LRALRGLVRL | KSLVDGNAVK | RQTAHTLHCT | QTMTRVQTQI | 200 |
| SEQ-ID-NO-138 | AFRGYLARRA | LRALRGLVRL | KSLVDGNAVK | RQTAHTLQQT | QNTRVQTQI | 195 |
| SEQ-ID-NO-149 | | | | | M | QTLARVQSQI | 11 |
| SEQ-ID-NO-151 | AFRGYLARRA | LRALRGLVRL | KSLIRGQSVK | RQATTTLRCM | QTLARLQSEI | 167 |

Figure 4 continued

```
SEQ ID NO:135    PARRIRMSEE NQAPQKQLLQ KHAKELAGLK ---NGENWNDS IQSKEKVEAN    221
SEQ ID NO:141                                                  -ESKEK       22
SEQ ID NO:147    RTPRIKMAEE NQALQRQLLL ---NQELEILR --GDQWNTS LQSKEQIEAS    108
SEQ ID NO:145    YSRRVKMEEE KQALQRQLQL KHQRELEKMK --IDEDWDHS HQSKEQVETS    248
SEQ ID NO:138    YSRRVKLEEE KQALQRQLQL KHQRELEKMK --IDEDWDHS HQSKEQIEAN    243
SEQ ID NO:149    RARRIRMSEE NEALQRQLQD KHDKELEKLR TSIGEQWDDS PQSKEEVEAS     61
SEQ ID NO:151    SARRIRMSEE NQALQRQLQQ KFQKELEKLR APMREDWNDS TQSKEQIEAR    217

SEQ ID NO:135    LLSKMEATMR RERALAYSYS HKQNWKNNSK SGNPMFMDPS NPTWGWSWLE    271
SEQ ID NO:141                                                              22
SEQ ID NO:147    LVSRQEAAAR RERALAYAFS HQ-WKSTSR SHNPMFVDPS NPHWGWSWLE    156
SEQ ID NO:145    LMMKQEAALR RERALAYAFS HQ-WKNSGR TITPTFTDCG NPNWGWSWWE    296
SEQ ID NO:138    LMMKQEAALR RERALAYAFS HQ-WRNSGR TITPTFTEPG NPNWGWSWWE    291
SEQ ID NO:149    LLQKQEAAMR RERALAYSYS HQQMWKQSSK SANETFMDPN NPIEWGWSWLE   111
SEQ ID NO:151    QQNKQFATMK RERALAYAYF HQRSWKNQSR SVNQTFMDPS NSHWGWSWLE    267

SEQ ID NO:135    RWMAGRPLES SE-KEQSNSN NDNAASVRG- ---------- -STNRNERA-   307
SEQ ID NO:141              ---------KEES NIDRGSVKSM PL-NLGEG- -EITKAFNR-    51
SEQ ID NO:147    RWMASRPFDG RNGASEKEGS SMDRITSVHST SIL-SMNLGEG EIVTKADNQV   205
SEQ ID NO:145    RWMTSRPWES RM-I-SDKD FKDRYSITKNF ST-------- -SRSRTFVF-   333
SEQ ID NO:138    RWMIARPWES RL-AAASDKD FKERAVIKMA ST-------- -SAVRVPVS-   330
SEQ ID NO:149    RWMAARPWES RI-----STID NNDRASVKST ISRTMSLG-- -EISRAYSR-   152
SEQ ID NO:151    RWMAARPWEV Q------STTD NNDRGSVKSM GAKSISIS-- -EISRAYSR-   308

SEQ ID NO:135    ---KSDTRNG STQPNTPSSA RGTPRNKNSF FSP--------P TPSRLNQESR    348
SEQ ID NO:141    ---RDSKLEK FSPFT-FFFA RFITSRHSFLT PSARVA----P LPARRRSVTP     94
SEQ ID NO:147    VDSLKPNDDK PPPLSTPKPS GFAPRGSPST PS--------- ALARKKSFTP    248
SEQ ID NO:145    ---RAISIQR PATPN-KSSI RPPSRGSPST PPSRMF----SI VTGKIRPASP    375
SEQ ID NO:138    ---RAISIQR PATPN-KSSI RPPSRQSDST PPSKTP----SI ASGKARPASP    372
SEQ ID NO:149    ---RDLNHDN KLSPSACKSS RPPSROSPST PPSKAFSTSS VTGKAKPPSP    199
SEQ ID NO:151    ---RDLNNDN KPSFTPQKSS RPPSRQSPST PPSKAPSISS VSGKTRLPSP    355
```

Figure 4 continued

| | | | | | | | |
|---|---|---|---|---|---|---|---|
| SEQ-ID-NO-136 | KSN----DDD | SKSTI SVLSE | RNRRHX AGS | SVXDDESLAG | SPALPSYMVP | | 394 |
| SEQ-ID-NO-141 | KNGLSQVDDD | ARSVLSVQSE | RPRRHSI ATS | TVRDDESLTS | SPSLPSYMVP | | 144 |
| SEQ-ID-NO-147 | KSGDCDGDDE | RSVVSTVRSE | RPRRHSIGAS | SVRDDFG---S | SFSVPSYMAA | | 296 |
| SEQ-ID-NO-145 | RDSWLYKEDD | LRSITSI RSE | RPRROSTGGA | SVRDDASLTS | TPALPSYMQS | | 425 |
| SEQ-ID-NO-138 | RNSWLYKEDD | LRSITSI RSE | RPRROSTGCE | SVRDCTSLTS | TPPLPSYMQS | | 422 |
| SEQ-ID-NO-149 | RGSAWGGDED | SRSTFSVQSE | RTRRHSIAGS | SIRDDESLAS | SPSVPSYMAP | | 249 |
| SEQ-ID-NO-151 | RGECWGGYED | SRSTLSTRSD | RYRRHSIAGS | SMRDDESLTS | SPAVPSYMAP | | 405 |

| | | | | | | | |
|---|---|---|---|---|---|---|---|
| SEQ-ID-NO-136 | T--KSARARL | RPCSFLG---G | --TQENEG | FTDKASAKKR | LSYHTSPALP | | 437 |
| SEQ-ID-NO-141 | T--ESARAKS | RLQGSAMANG | --AETPEKG | -GSTGFAKKR | LSFCGGTAAA | | 198 |
| SEQ-ID-NO-147 | TKSABARAKS | RYQSPTLTEG | AAQAETLEKG | WSBVGSAKKR | LSFFAGTPPP | | 346 |
| SEQ-ID-NO-145 | T--ESARAKS | RTRSFLLTDR | --FEMPERV | PLVHSSTKKR | LSFPVBDKPN | | 469 |
| SEQ-ID-NO-138 | T--ESARAKS | RYRSLLLTEK | --LEMPERA | PLAHSVVKKR | LSFPVVEKPS | | 467 |
| SEQ-ID-NO-149 | TRSDSAKAKS | BLSSFLGIDN | --NGTPDKA | --SVGYVKKR | LSFSASPAGA | | 294 |
| SEQ-ID-NO-151 | T--GSTKARS | RLPSPL---G | --SGTPDRR | --VAGSAKKR | LTFDASPASS | | 446 |

| | | | | | | | |
|---|---|---|---|---|---|---|---|
| SEQ-ID-NO-136 | ----------K | PRRFSAPPKV | ESGGVT----- | -------VTNGA | GS---- | | 461 |
| SEQ-ID-NO-141 | ---------SP | NRRHSGPPKV | ETAPPQ----- | -PDALVVNGG | SK---- | | 217 |
| SEQ-ID-NO-147 | -------VPAAA | ARRHSCPPKV | RCAGVEGGTE | ERDSSLA---- | ------ | | 378 |
| SEQ-ID-NO-145 | GEHADKLMER | GRRHSCPPKV | DPASLK----- | ----DVPVS-- | ------ | | 500 |
| SEQ-ID-NO-138 | VVPTEKPRER | VRRHSDPPKV | DPATLK----- | ----DAPAA-- | ------ | | 498 |
| SEQ-ID-NO-149 | ----------- | -RRHSGPPRV | DASAVKDI OM | HREEKNSNGA | SSK--- | | 326 |
| SEQ-ID-NO-151 | ----------- | -RRHSFPPKV | DISEAR----- | KNQHAPSNGR | QVAW-- | | 474 |

[Sequence alignment figure showing SEQ ID NOs: 24, 33, 2, 19, 13, 29, 8, 27 with protein sequences and position numbers. Figure content is a bioinformatics sequence alignment not suitable for tabular transcription.]

Figure 6

| | | | | | | |
|---|---|---|---|---|---|---|
| SEQ-ID-NO-35 | MRGFPVPVTS | WSSAALLGRS | SSARDAAEA | SSPITAAEMV | RVAKEVANAA | 50 |
| SEQ-ID-NO-36 | ------MESRL | LRSAALLARA | ARLARAAATS | TGRAVTAE-- | HLAEVVASAA | 43 |
| SEQ-ID-NO-35 | DACGVSGKKL | LEAAEALSRS | DTDAEPRRRA | AERIFDAASM | VAKEADASGA | 100 |
| SEQ-ID-NO-36 | GDRGFPSGAL | RQAALALARS | ---SAPEARPRA | TAEVVRAAAM | VFRAAQEAGS | 92 |
| SEQ-ID-NO-35 | SGLSDAAQNL | TCATYAFSVA | ASGWGSLPES | STSGRDAGDL | LTEPLLGSCC | 150 |
| SEQ-ID-NO-36 | PGVAEVAGDL | AHAAHDCVRA | ---LVES | GPAAERPRCL | LR----WRRKN | 134 |
| SEQ-ID-NO-35 | DKNEKMTGEG | KDFSEM---- | RNSAADSDPL | CQSEIKESSL | FGKCKELLNY | 196 |
| SEQ-ID-NO-36 | RHNKNAAGEA | DLEAPLLHPH | ERPSSSSSPI | GASLSEIIEL | SESERDFINY | 184 |
| SEQ-ID-NO-35 | GFLGGPALLP | VL---GSGLRK | TVSPCSPSVF | HYIFSSWWIC | ------ | 235 |
| SEQ-ID-NO-36 | GMFGALAIFP | VLTRTGGLKS | AYSPLSPSTF | HIIFCTWWIC | VGLDVLCGNR | 234 |
| SEQ-ID-NO-35 | ---------- | GRAMMKNILA | FILAFYARAS | ARLAILGVSL | LVILYSHLEL | APNEIYTLYI | 235 |
| SEQ-ID-NO-36 | | | | | | | 284 |
| SEQ-ID-NO-35 | VVGSHEQGDL | KILHIDRITS | HPND---K | 260 |
| SEQ-ID-NO-36 | LLGAATCMHL | LVWAMDYMSR | APGDAAD | 311 |

NUCLEOTIDE SEQUENCES AND CORRESPONDING POLYPEPTIDES CONFERRING MODULATED GROWTH RATE AND BIOMASS IN PLANTS GROWN IN SALINE AND OXIDATIVE CONDITIONS

CROSS-REFERENCE TO RELATED APPLICATIONS

This application is a Divisional of co-pending application Ser. No. 11/858,117, filed on Sep. 19, 2007 which is a Continuation in Part of Application No. PCT/US2007/06544, filed on Mar. 14, 2007, and claims priority under 35 U.S. §120 of Application No. PCT/US2007/06544, which claims priority under 35 U.S.C. §119 of U.S. Provisional No. 60/782,735, filed on Mar. 14, 2006, the contents of each of which which are hereby incorporated by reference in their entirety.

SEQUENCE LISTING

Applicants herein provide a Sequence Listing to be inserted into the Specification immediately before the claims. The text file titled 2015-08-18 2750-1674PUS4$_{13}$ST25.txt of size 591 kb created Aug. 20, 2015, filed herewith, is hereby incorporated by reference.

TECHNICAL FIELD

The present invention relates to isolated nucleic acid molecules and their corresponding encoded polypeptides able to enhance plant growth under saline and/or oxidative stress conditions. The present invention further relates to using the nucleic acid molecules and polypeptides to make transgenic plants, plant cells, plant materials or seeds of a plant having improved growth rate, vegetative growth, seedling vigor and/or biomass under saline and/or oxidative stress conditions as compared to wild-type plants grown under similar conditions.

BACKGROUND

Plants specifically improved for agriculture, horticulture, biomass conversion, and other industries (e.g. paper industry, plants as production factories for proteins or other compounds) can be obtained using molecular technologies. As an example, great agronomic value can result from enhancing plant growth in saline and/or oxidative stress conditions.

Salinity

A wide variety agriculturally important plant species demonstrate significant sensitivity to saline and/or oxidative stress conditions. Upon salt concentration exceeding a relatively low threshold, many plants suffer from stunted growth, necrosis, and death that results in an overall stunted appearance and reduced yields of plant material, seeds, fruit and other valuable products. Physiologically, plants challenged with salinity experience disruption in ion and water homeostasis, inhibition of metabolism, and damage to cellular membranes that result in developmental arrest and cell death (Huh et al. (2002) *Plant J,* 29(5): 649-59).

In many of the world's most productive agricultural regions, agricultural activities themselves lead to increased water and soil salinity, which threatens their sustained productivity. One example is crop irrigation in arid regions that have abundant sunlight. After irrigation water is applied to cropland, it is removed by the processes of evaporation and transpiration. While these processes remove water from the soil, they leave behind dissolved salts carried in irrigation water. Consequently, soil and groundwater salt concentrations build over time, rendering the land and shallow groundwater saline and thus damaging to crops.

In addition to human activities, natural geological processes have created vast tracts of saline land that would be highly productive if not saline. In total, approximately 20% of the irrigated lands are negatively affected by salinity. (Yamaguchi and Blumwald, 2005, *Trends in Plant Science,* 10: 615-620). For these and other reasons, it is of great interest and importance to identify genes that confer improved salt tolerance characteristics to thereby enable one to create transgenic plants (such as crop plants) with enhanced growth and/or productivity characteristics in saline conditions.

Despite this progress, today there continues to be a great need for generally applicable processes that improve forest or agricultural plant growth to suit particular needs depending on specific environmental conditions. To this end, the present invention is directed to advantageously manipulating plant tolerance to salinity in order to maximize the benefits of various crops depending on the benefit sought, and is characterized by expression of recombinant DNA molecules in plants. These molecules may be from the plant itself, and simply expressed at a higher or lower level, or the molecules may be from different plant species.

Oxidative Stress

Plants lead a sessile lifestyle and so are generally destined to reside where their seed germinates. Consequently, they can be exposed to unfavorable environmental conditions arising from weather, pollution and location. Stress conditions, such as extremes in temperature, drought and desiccation, salinity, soil nutrient content, heavy metals, UV radiation, pollutants such as ozone and $SO_2$, mechanical stress, high light and pathogen attack, have a large impact on plant growth and development. These types of stress exposure induce formation of toxic oxygen species, which are generated in all aerobic cells and are associated with oxidative damage at the cellular level. Several recently published reports have characterized toxic oxygen species generation and the subsequent oxidative damage caused by abiotic stresses (see Larkindale and Knight (2002); Borsani et al. (2001); Lee et al (2004); Aroca et al (2005); Luna et al (2005); and Noctor et al (2002)).

The toxic oxygen species are referred to as reactive oxygen species (ROS), reactive oxygen intermediates (ROI) or activated oxygen species (AOS) and are partially reduced or activated derivatives of oxygen. ROS/ROI/AOS include the oxygen-centered superoxide ($O_2$) and hydroxyl (.OH) free radicals as well as hydrogen peroxide ($H_2O_2$), nitric oxide (NO) and $O_2{}^1$. These oxygen species are generated as byproducts from reactions that occur during photosynthesis, respiration and photorespiration, and are predominantly formed in the chloroplasts, mitochondria, endoplasmic reticulum, microbodies (e.g. peroxisomes and glyoxysomes), plasma membranes and cell walls. While the toxicity of $O_2{}^-$ and $H_2O_2$ themselves is relatively low, their metal-dependent conversion to highly toxic .OH is thought to be responsible for the majority of the biological damage associated with these molecules.

Oxidative stress damages cell structure and affects cell metabolism and catabolism. Membrane lipids are subject to oxidation by ROS/ROI/AOS, resulting in accumulation of high molecular weight, cross-linked fatty acids and phospholipids. Oxidative attack on proteins results in site-specific amino acid modifications, fragmentation of the peptide chain, aggregation of cross-linked reaction products, altered electrical charge and increased susceptibility to proteolysis, all of which frequently leads to elimination of enzyme activity. ROS/ROI/AOS that generate oxygen free radicals, such as ionizing radiation, also induce numerous lesions in DNA at both the sugar and base moieties which cause deletions, mutation and other lethal genetic effects such as base degradation, single strand breakage and cross-linking to proteins. Morphologically, the adverse effects of high levels of ROS accumulation are manifested as stunted growth and necrotic lesions.

Although capable of producing damage, ROS/ROI/AOS are also key regulators of metabolic and defense pathways, playing roles as signaling or secondary messenger molecules. For example, pathogen-induced ROS/ROI/AOS production is critical in disease resistance where these molecules are involved at three different levels: penetration resistance, hypersensitive response (HR) and systemic acquired resistance (Levine et al. (1994); Lamb and Dixon (1997); Zhou et al. (2000); Aviv et al. (2002)). In penetration resistance, ROS/ROI/AOS function by reinforcing cell walls through polyphenolic cross-linking. With respect to hypersensitive response, $H_2O_2$ is an active signaling molecule whose effect is dose dependent. At high dosages, $H_2O_2$ triggers hypersensitive cell death and thus restricts the pathogen to local infection sites (Lamb and Dixon (1997)) while low dosages block cell cycle progression (Reichheld et al. (1999)) and signal secondary wall differentiation (Potikha et al. (1999)). Lastly, ROS/ROI/AOS molecules play a role in broad-spectrum systemic acquired disease resistance by triggering micro-HR systematically after the first pathogen inoculation.

In the signal cascades leading to oxidative stress, salicylic acid (SA) has been identified as an important signaling molecule to mediate ROS/ROI/AOS accumulation in various stress conditions, such as salt and osmotic stress (Borsani et al. (2001)), drought (Senaratna et al. (2000)), heat (Dat et al. (1998)), cold (Scott et al. (2004)), UV-light (Surplus et al. (1998)), paraquat (Kim et al. (2003)) and disease resistance against different pathogens (Zhou et al. (2004)). High levels of SA induce $H_2O_2$ production as well as cell death.

Several signaling components required for SA-mediated ROS/ROI/AOS accumulation and gene expression have been characterized. For example, NPR1 is required for SA-induced PR gene expression and disease resistance (Cao et al. (1994)). The mutations in eds1 and eds5 block SA-mediated signaling and enhance disease susceptibility (Rusterucci et al. (2001)). Over-expression of NahG in various plant species also suppresses SA-induced responses to both abiotic and biotic stresses (Delaney et al. (1994)). Recently, Scott and colleagues (2004) reported that chilling treatment induced accumulation of SA in *Arabidopsis* and the degradation of SA by overexpression of NahG enhanced cold tolerance in a transgenic plant.

SA, as a phytohormone, also promotes early flowering (Martinez et al. (2004)). SA at various levels may play different roles in plant growth and stress responses. However, most of the time, the increased tolerance to high levels of SA appears to be beneficial, since it reduces the side effects of SA accumulation while stimulating SA-mediated stress responses.

Similarly, NO is capable of generating ROS/ROI/AOS and is a plant signaling molecule involved in the regulation of seed germination, stomatal closure (Mata and Lamattina (2001); Desikan et al (2002)), flowering time (He et al. (2004)), antioxidant reactions to suppress cell death (Beligni et al. (2002)) and tolerance to biotic and abiotic stress conditions (Mata and Lamattina (2001)). While the effects of NO can be mimicked through the application of sodium nitroprusside (SNP), endogenous NO production in plants results from the activity of a nitric oxide synthase that uses L-arginine (Guo et al. (2003)) as well as nitrate reductase-mediated reactions (Desikan et al (2002)). NO can react with redox centers in proteins and membranes, thereby causing cell damage and inducing cell death.

In order to control the two-fold nature of ROS/ROI/AOS molecules, plants have developed a sophisticated regulatory system which involves both production and scavenging of ROS/ROI/AOS in cells. During normal growth and development, this pathway monitors the level of ROS/ROI/AOS produced by metabolism and controls the expression and activity of ROS/ROI/AOS scavenging pathways. The major ROS/ROI/AOS scavenging mechanisms include the action of the superoxide dismutase (SOD), ascorbate perioxidase (APX) and catalase (CAT) enzymes as well as nonenzymatic components such as ascorbic acid, α-tocopherol and glutathione.

The antioxidant enzymes are believed to be critical components in preventing oxidative stress, in part because pretreatment of plants with one form of stress, and which induces expression of these enzymes, can increase tolerance for a different stress (cross-tolerance) Allen (1995)). In addition, plant lines selected for resistance to herbicides that function by inducing ROS/ROI/AOS generally have increased levels of one or more of these antioxidant enzymes and also exhibit cross-tolerance (Gressel and Galun (1994)).

Plant development and yield depend on the ability of the plant to manage oxidative stress, whether it is via the signaling or the scavenging pathways. Consequently, improvements in a plant's ability to withstand oxidative stress, or to obtain a higher degree of cross-tolerance once oxidative stress has been experienced, has significant value in agriculture. The sequences and methods of the invention provide the means by which tolerance to oxidative stress can be improved, either via the signaling or the scavenging pathways.

The availability and sustainability of a stream of food and feed for people and domesticated animals has been a high priority throughout the history of human civilization and lies at the origin of agriculture. Specialists and researchers in the fields of agronomy science, agriculture, crop science, horticulture, and forest science are even today constantly striving to find and produce plants with an increased growth potential to feed an increasing world population and to guarantee a supply of reproducible raw materials. The robust level of research in these fields of science indicates the level of importance leaders in every geographic environment and climate around the world place on providing sustainable sources of food, feed and energy.

Manipulation of crop performance has been accomplished conventionally for centuries through selection and plant breeding. The breeding process is, however, both time-consuming and labor-intensive. Furthermore, appropriate breeding programs must be specially designed for each relevant plant species.

On the other hand, great progress has been made in using molecular genetic approaches to manipulate plants to provide better crops. Through the introduction and expression of recombinant nucleic acid molecules in plants, researchers are now poised to provide the community with plant species tailored to grow more efficiently and yield more product despite suboptimal geographic and/or climatic environments. These new approaches have the additional advantage of not being limited to one plant species, but instead being applicable to multiple different plant species (Zhang et al. (2004) *Plant Physiol.* 135:615; Zhang et al. (2001) *Proc. Natl. Acad. Sci. USA* 98:12832).

SUMMARY

This document provides methods and materials related to plants having modulated levels of tolerance to salinity and/or oxidative stress. For example, this document provides transgenic plants and plant cells having increased levels of tolerance to salinity and/or oxidative stress, nucleic acids used to generate transgenic plants and plant cells having increased levels of tolerance to salinity and/or oxidative stress, and methods for making plants and plant cells having increased levels of tolerance to salinity and/or oxidative stress. Such plants and plant cells provide the opportunity to produce crops or plants under saline and/or oxidative stress conditions without stunted growth and diminished yields. Increased levels of tolerance to salinity and/or oxidative stress may be useful to produce biomass which may be converted to a liquid fuel or other chemicals and/or to produce food and feed on land that is currently marginally productive, resulting in an overall expansion of arable land.

Methods of producing a plant and/or plant tissue are provided herein. In one aspect, a method comprises growing a plant cell comprising an exogenous nucleic acid. The exogenous nucleic acid comprises a regulatory region operably linked to a nucleotide sequence encoding a polypeptide. The Hidden Markov Model (HMM) bit score of the amino acid sequence of the polypeptide is greater than about 30 using an HMM generated from the amino acid sequences depicted in one of FIGS. 1-6. The plant and/or plant tissue has a difference in the level of tolerance to salinity and/or oxidative stress as compared to the corresponding level in tolerance to salinity and/or oxidative stress of a control plant that does not comprise the exogenous nucleic acid. In some embodiments the amino acid sequence of the polypeptide has an HMM bit score greater than about 400 using an HMM generated from the amino acid sequences depicted in FIG. 1. In some embodiments the amino acid sequence of the polypeptide has an HMM bit score greater than about 30 using an HMM generated from the amino acid sequences depicted in FIG. 2. In some embodiments the amino acid sequence of the polypeptide has an HMM bit score greater than about 120 using an HMM generated from the amino acid sequences depicted in FIG. 3. In some embodiments the amino acid sequence of the polypeptide has an HMM bit score greater than about 150 using an HMM generated from the amino acid sequences depicted in FIG. 4. In some embodiments the amino acid sequence of the polypeptide has an HMM bit score greater than about 425 using an HMM generated from the amino acid sequences depicted in FIG. 5. In some embodiments the amino acid sequence of the polypeptide has an HMM bit score greater than about 550 using an HMM generated from the amino acid sequences depicted in FIG. 6.

In another aspect, a method comprises growing a plant cell comprising an exogenous nucleic acid. The exogenous nucleic acid comprises a regulatory region operably linked to a nucleotide sequence encoding a polypeptide having 85 percent or greater sequence identity to an amino acid sequence set forth in SEQ ID NOs: 2, 4, 6, 8, 9, 11, 13, 14, 15, 17, 19, 20, 22, 23, 24, 25, 27, 29, 30, 31, 33, 35, 36, 37, 38, 39, 41, 42, 43, 44, 45, 47, 49, 50, 52, 54, 56, 58, 60, 62, 63, 64, 66, 68, 69, 71, 73, 74, 76, 78, 80, 81, 83, 84, 86, 88, 90, 91, 93, 94, 96, 98, 100, 101, 102, 104, 106, 107, 109, 110, 112, 114, 116, 118, 119, 121, 122, 123, 125, 126, 127, 128, 129, 130, 132, 134, 136, 138, 140, 141, 142, 143, 144, 145, 147, 149, 151, 153, 154, 156, 158, 160, 162, 163, 165, 166, 167, 168, and amino acid coordinates 1 to 135 of SEQ ID NO: 138. A plant produced from the plant cell has a difference in the level of tolerance to salinity and/or oxidative stress as compared to the corresponding level in a control plant that does not comprise the exogenous nucleic acid.

In another aspect, a method comprises growing a plant cell comprising an exogenous nucleic acid. The exogenous nucleic acid comprises a regulatory region operably linked to a nucleotide sequence having 85 percent or greater sequence identity to at least a fragment of a nucleotide sequence set forth in SEQ ID NOs. 1, 3, 5, 7, 10, 12, 16, 18, 21, 26, 28, 32, 34, 40, 46, 48, 51, 53, 55, 57, 59, 61, 65, 67, 70, 72, 75, 77, 79, 82, 85, 87, 89, 92, 95, 97, 99, 103, 105, 108, 111, 113, 115, 117, 120, 124, 131, 133, 135, 137, 139, 146, 148, 150, 152, 155, 157, 159, 161, and 164 and to a nucleotide sequence encoding any of the amino acid sequences set forth in the sequence listing. A plant and/or plant tissue produced from the plant cell has a difference in the level of salinity and/or oxidative stress tolerance as compared to the corresponding level in a control plant that does not comprise the exogenous nucleic acid.

Methods of modulating the level of salt tolerance and/or oxidative stress tolerance in a plant are provided herein. In one aspect, a method comprises introducing into a plant cell an exogenous nucleic acid, that comprises a regulatory region operably linked to a nucleotide sequence encoding a polypeptide. The HMM bit score of the amino acid sequence of the polypeptide is greater than 30, using an HMM generated from the amino acid sequences depicted in one of FIGS. 1-6. A plant and/or plant tissue produced from the plant cell has a difference in the level of tolerance to salinity and/or oxidative stress as compared to the corresponding level in a control plant that does not comprise the exogenous nucleic acid.

In another aspect, a method comprises introducing into a plant cell an exogenous nucleic acid that comprises a regulatory region operably linked to a nucleotide sequence encoding a polypeptide having 85% percent or greater sequence identity to an amino acid sequence set forth in SEQ ID NOs: 2, 4, 6, 8, 9, 11, 13, 14, 15, 17, 19, 20, 22, 23, 24, 25, 27, 29, 30, 31, 33, 35, 36, 37, 38, 39, 41, 42, 43, 44, 45, 47, 49, 50, 52, 54, 56, 58, 60, 62, 63, 64, 66, 68, 69, 71, 73, 74, 76, 78, 80, 81, 83, 84, 86, 88, 90, 91, 93, 94, 96, 98, 100, 101, 102, 104, 106, 107, 109, 110, 112, 114, 116, 118, 119, 121, 122, 123, 125, 126, 127, 128, 129, 130, 132, 134, 136, 138, 140, 141, 142, 143, 144, 145, 147, 149, 151, 153, 154, 156, 158, 160, 162, 163, 165, 166, 167, 168, and amino acid coordinates 1 to 135 of SEQ ID NO: 138. A plant and/or plant tissue produced from the plant cell has a difference in the level of tolerance to salinity or oxidative stress as compared to the corresponding level in a control plant that does not comprise the exogenous nucleic acid.

In some embodiments, the methods comprise introducing into the plant cell an exogenous nucleic acid encoding polypeptides selected from the group consisting of SEQ ID NOs: 43, 44, 45, 86, 140, 141, 142, 143, 144, and amino acid coordinates 1 to 135 of SEQ ID NO: 138. A plant and/or plant tissue produced from the plant cell has a difference in the level of tolerance to salinity as compared to the corresponding level in a control plant that does not comprise the exogenous nucleic acid. In some embodiments, the methods comprise introducing into the plant cell an exogenous nucleic acid encoding polypeptides selected from the group consisting of SEQ ID NO: 136, and 141, and a plant and/or plant tissue produced from the plant cell has a difference in the level of tolerance to oxidative stress as compared to the corresponding level in a control plant that does not comprise the exogenous nucleic acid.

In another aspect, a method comprises introducing into a plant cell an exogenous nucleic acid, that comprises a regulatory region operably linked to a nucleotide sequence having 85 percent or greater sequence identity to a nucleotide sequence set forth in SEQ ID NOs: 1, 3, 5, 7, 10, 12, 16, 18, 21, 26, 28, 32, 34, 40, 46, 48, 51, 53, 55, 57, 59, 61, 65, 67, 70, 72, 75, 77, 79, 82, 85, 87, 89, 92, 95, 97, 99, 103, 105, 108, 111, 113, 115, 117, 120, 124, 131, 133, 135, 137, 139, 146, 148, 150, 152, 155, 157, 159, 161, and 164 and to a nucleotide sequence encoding any of the amino acid sequences set forth in the sequence listing. A plant and/or plant tissue produced from the plant cell has a difference in the level of tolerance to salinity or oxidative stress as compared to the corresponding level in a control plant that does not comprise the exogenous nucleic acid.

Plant cells comprising an exogenous nucleic acid are provided herein. In one aspect, the exogenous nucleic acid comprises a regulatory region operably linked to a nucleotide sequence encoding a polypeptide. The HMM bit score of the amino acid sequence of the polypeptide is greater than 30, using an HMM based on the amino acid sequences depicted in one of FIGS. 1-6. The plant and/or plant tissue has a difference in the level of tolerance to salinity or oxidative stress as compared to the corresponding level in a control plant that does not comprise the exogenous nucleic acid. In another aspect, the exogenous nucleic acid comprises a regulatory region operably linked to a nucleotide sequence encoding a polypeptide having 85 percent or greater sequence identity to an amino acid sequence selected from the group consisting of SEQ ID NOs: 2, 4, 6, 8, 9, 11, 13, 14, 15, 17, 19, 20, 22, 23, 24, 25, 27, 29, 30, 31, 33, 35, 36, 37, 38, 39, 41, 42, 43, 44, 45, 47, 49, 50, 52, 54, 56,58, 60, 62, 63, 64, 66, 68, 69, 71, 73, 74, 76, 78, 80, 81, 83, 84, 86, 88, 90, 91, 93, 94, 96, 98, 100, 101, 102, 104, 106, 107, 109, 110, 112, 114, 116, 118, 119, 121, 122, 123, 125, 126, 127, 128, 129, 130, 132, 134, 136, 138, 140, 141, 142, 143, 144, 145, 147, 149, 151, 153, 154, 156, 158, 160, 162, 163, 165, 166, 167, 168, and amino acid coordinates 1 to 135 of SEQ ID NO: 138. A plant and/or plant tissue produced from the plant cell has a difference in the level of tolerance to salinity or oxidative stress as compared to the corresponding level in a control plant that does not comprise the exogenous nucleic acid. In another aspect, the exogenous nucleic acid comprises a regulatory region operably linked to a nucleotide sequence having 85 percent or greater sequence identity to at least a fragment of a nucleotide sequence selected from the group consisting of SEQ ID Nos. 1, 3, 5, 7, 10, 12, 16, 18, 21, 26, 28, 32, 34, 40, 46, 48, 51, 53, 55, 57, 59, 61, 65, 67, 70, 72, 75, 77, 79, 82, 85, 87, 89, 92, 95, 97, 99, 103, 105, 108, 111, 113, 115, 117, 120, 124, 131, 133, 135, 137, 139, 146, 148, 150, 152, 155, 157, 159, 161, and 164, and to a nucleotide sequence encoding any of the amino acid sequences set forth in the sequence listing. A plant and/or plant tissue produced from the plant cell has a difference in the level of tolerance to salinity or oxidative stress as compared to the corresponding level in a control plant that does not comprise the exogenous nucleic acid. A transgenic plant comprising such a plant cell is also provided. In some embodiments, the transgenic plant is a member of a species selected from the group consisting of *Panicum virgatum* (switchgrass), *Sorghum bicolor* (sorghum, sudangrass), *Miscanthus giganteus* (miscanthus), *Saccharum* sp. (energycane), *Populus balsamifera* (poplar), *Zea mays* (corn), *Glycine max* (soybean), *Brassica napus* (canola), *Triticum aestivum* (wheat), *Gossypium hirsutum* (cotton), *Oryza sativa* (rice), *Helianthus annuus* (sunflower), *Medicago sativa* (alfalfa), *Beta vulgaris* (sugarbeet), or *Pennisetum glaucum* (pearl millet). Some embodiments are related o products comprising seed or vegetative tissue from transgenic plants as described above. Some embodiments relate to food or feed products from transgenic plants as described above.

In another aspect, an isolated nucleic acid comprises a nucleotide sequence encoding a polypeptide having 80% or greater sequence identity to the amino acid sequence set forth in SEQ ID Nos. 2, 4, 6, 22, 27, 29, 49, 52, 54, 56, 60, 62, 68, 76, 83, 88, 90, 96, 98, 104, 106, 112, 114, 132, 134, 149, 151, or 160.

In another aspect, methods of identifying a genetic polymorphism associated with variation in the level of salinity and/or oxidative stress tolerance are provided. The methods include providing a population of plants, and determining whether one or more genetic polymorphisms in the population are genetically linked to the locus for a polypeptide selected from the group consisting of the polypeptides depicted in FIGS. 1-6 and functional homologs thereof. The correlation between variation in the level of salinity tolerance and/or oxidative stress tolerance in plants and/or plant tissues of the population and the presence of the one or more polymorphisms in plants of the population is measured, thereby permitting identification of whether or not the one or more polymorphisms are associated with such variation.

In another aspect, methods of making a plant line is provided. The methods include determining whether one or more genetic polymorphisms in a population of plants is associated with the locus for a polypeptide selected from the group consisting of the polypeptides depicted in FIGS. 1-6 and functional homologs thereof, identifying one or more plants in the population in which the presence of at least one allele at the one or more polymorphisms is associated with variation in salt tolerance or oxidative stress tolerance, crossing each of the one or more identified plants with itself or a different plant to produce seed, crossing at least one progeny plant grown from said seed with itself or a different plant, and repeating the crossing steps for an additional 0-5 generations to make the plant line. The at least one allele will be present in the plant line. The method of making a plant line may be applied, for example, to a population of switchgrass plants.

Unless otherwise defined, all technical and scientific terms used herein have the same meaning as commonly understood by one of ordinary skill in the art to which this invention pertains. Although methods and materials similar or equivalent to those described herein can be used to practice the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

The details of one or more embodiments of the invention are set forth in the accompanying drawings and the description below. Other features, objects, and advantages of the invention will be apparent from the description and drawings, and from the claims.

BRIEF DESCRIPTION OF THE FIGURES

Figure 1:
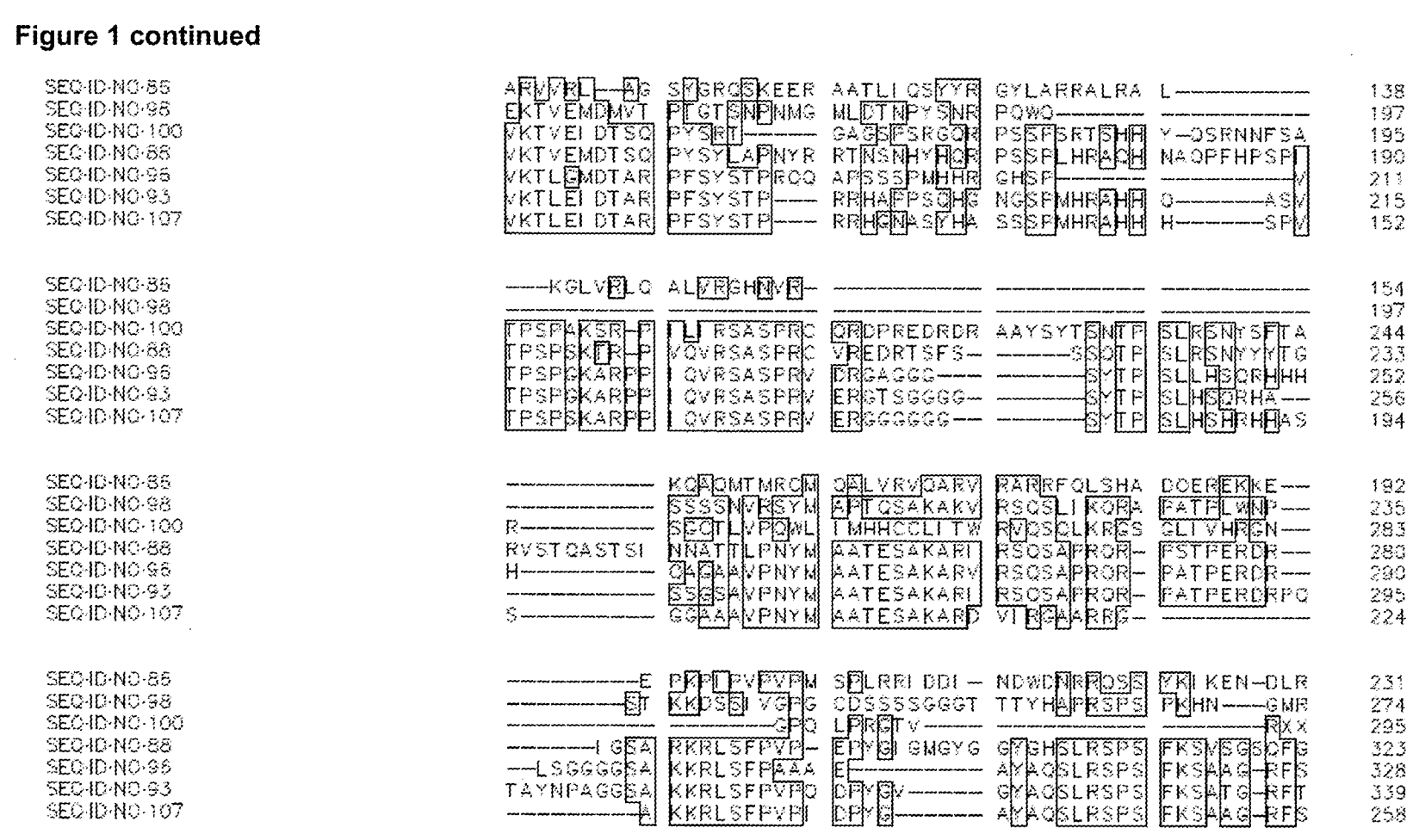

FIG. 1 is an alignment of amino acid sequences of homologues of (ME08768; SEQ ID NO: 86). In all the alignment Figures shown herein, a dash in an aligned sequence represents a gap, i.e., a lack of an amino acid at that position. Identical amino acids or conserved amino acid substitutions among aligned sequences are identified by boxes. FIG. 1 and the other alignment Figures provided herein were generated using the program MUSCLE version 3.52

FIG. 2 is an alignment of amino acid sequences of homologues of ME06748 (SEQ ID NO: 41).

FIG. 4 is an alignment of amino acid sequences of homologues of Ceres Clone 375578 (SEQ ID NO: 138).

FIG. 5 is an alignment of amino acid sequences of homologues of Ceres Clone ID No. 1792354 (SEQ ID NO:2).

FIG. 6 is an alignment of amino acid sequences of homologues of Ceres Clone ID No. 56784328 (SEQ ID NO: 35).

DETAILED DESCRIPTION

Figure 3:
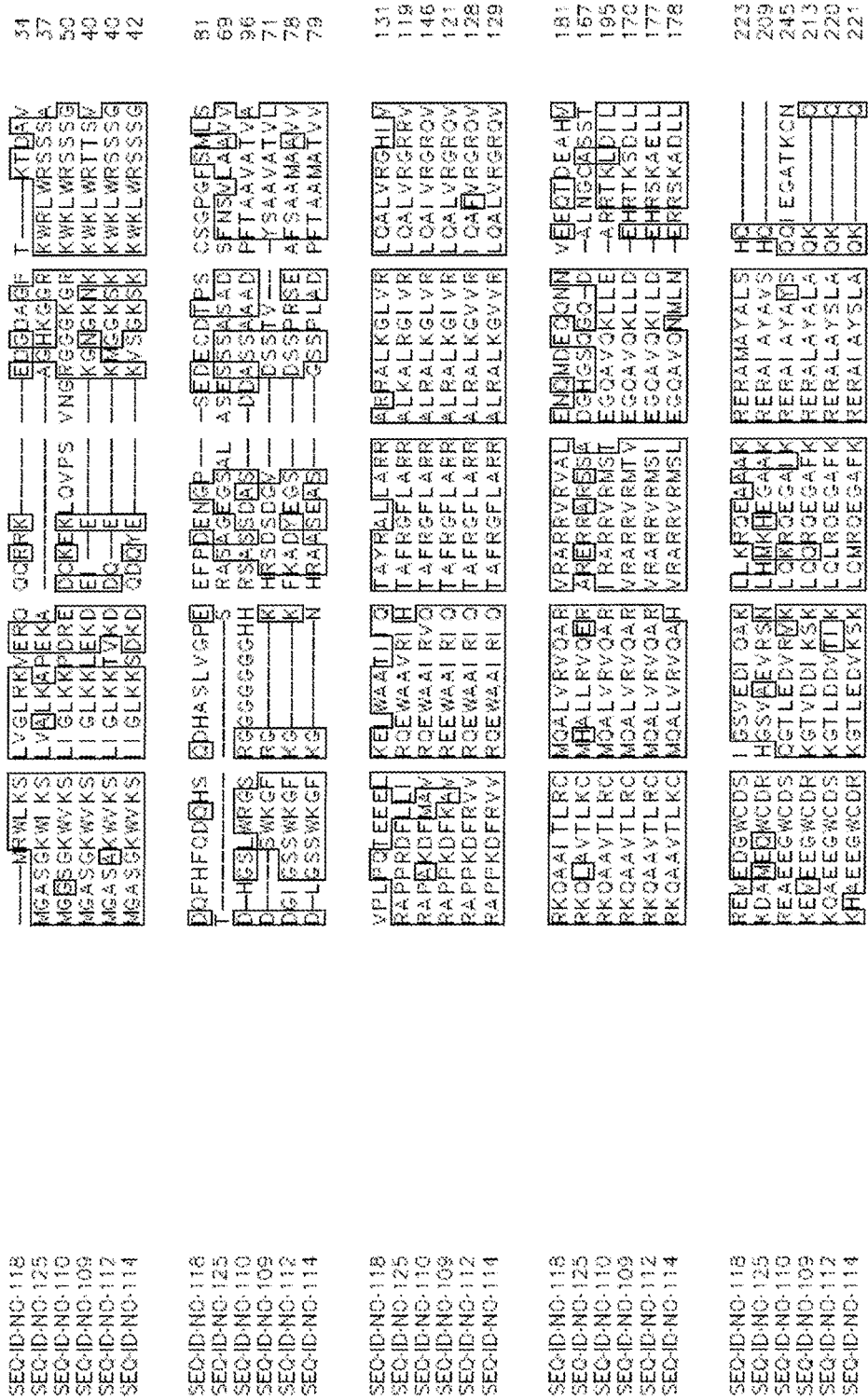
FIG. 3 is an alignment of amino acid sequences of homologues of ME19173 (SEQ ID NO: 109).

The invention features methods and materials related to modulating salinity tolerance and/or oxidative stress tolerance levels in plants and/or plant tissues. In some embodiments, the plants may also have increased biomass and/or yield. The methods can include transforming a plant cell with a nucleic acid encoding a salinity and/or oxidative stress tolerance-modulating polypeptide, wherein expression of the polypeptide results in a modulated level of salinity tolerance and/or oxidative stress tolerance. Plant cells produced using such methods can be grown to produce plants having an increased salinity tolerance, oxidative stress tolerance, and/or biomass, in comparison to wild type plants grown under the same conditions. Such plants, and the seeds of such plants, may be used to produce, for example, yield and/or biomass utilized for biofuel production, such as, but not limited to, ethanol and butanol.

I. Definitions

"Amino acid" refers to one of the twenty biologically occurring amino acids and to synthetic amino acids, including D/L optical isomers.

"Cell type-preferential promoter" or "tissue-preferential promoter" refers to a promoter that drives expression preferentially in a target cell type or tissue, respectively, but may also lead to some transcription in other cell types or tissues as well.

"Control plant" refers to a plant that does not contain the exogenous nucleic acid present in a transgenic plant of interest, but otherwise has the same or similar genetic background as such a transgenic plant. A suitable control plant can be a non-transgenic wild type plant, a non-transgenic segregant from a transformation experiment, or a transgenic plant that contains an exogenous nucleic acid other than the exogenous nucleic acid of interest.

"Domains" are groups of substantially contiguous amino acids in a polypeptide that can be used to characterize protein families and/or parts of proteins. Such domains have a "fingerprint" or "signature" that can comprise conserved primary sequence, secondary structure, and/or three-dimensional conformation. Generally, domains are correlated with specific in vitro and/or in vivo activities. A domain can have a length of from 10 amino acids to 400 amino acids, e.g., 10 to 50 amino acids, or 25 to 100 amino acids, or 35 to 65 amino acids, or 35 to 55 amino acids, or 45 to 60 amino acids, or 200 to 300 amino acids, or 300 to 400 amino acids.

"Down-regulation" refers to regulation that decreases production of expression products (mRNA, polypeptide, or both) relative to basal or native states.

"Exogenous" with respect to a nucleic acid indicates that the nucleic acid is part of a recombinant nucleic acid construct, or is not in its natural environment. For example, an exogenous nucleic acid can be a sequence from one species introduced into another species, i.e., a heterologous nucleic acid. Typically, such an exogenous nucleic acid is introduced into the other species via a recombinant nucleic acid construct. An exogenous nucleic acid can also be a sequence that is native to an organism and that has been reintroduced into cells of that organism. An exogenous nucleic acid that includes a native sequence can often be distinguished from the naturally occurring sequence by the presence of non-natural sequences linked to the exogenous nucleic acid, e.g., non-native regulatory sequences flanking a native sequence in a recombinant nucleic acid construct. In addition, stably transformed exogenous nucleic acids typically are integrated at positions other than the position where the native sequence is found. It will be appreciated that an exogenous nucleic acid may have been introduced into a progenitor and not into the cell under consideration. For example, a transgenic plant containing an exogenous nucleic acid can be the progeny of a cross between a stably transformed plant and a non-transgenic plant. Such progeny are considered to contain the exogenous nucleic acid.

"Expression" refers to the process of converting genetic information of a polynucleotide into RNA through transcription, which is catalyzed by an enzyme, RNA polymerase, and into protein, through translation of mRNA on ribosomes.

"Heterologous polypeptide" as used herein refers to a polypeptide that is not a naturally occurring polypeptide in a plant cell, e.g., a transgenic *Panicum* virgatum plant transformed with and expressing the coding sequence for a nitrogen transporter polypeptide from a *Zea mays* plant.

"Isolated nucleic acid" as used herein includes a naturally-occurring nucleic acid, provided one or both of the sequences immediately flanking that nucleic acid in its naturally-occurring genome is removed or absent. Thus, an isolated nucleic acid includes, without limitation, a nucleic acid that exists as a purified molecule or a nucleic acid molecule that is incorporated into a vector or a virus. A nucleic acid existing among hundreds to millions of other nucleic acids within, for example, cDNA libraries, genomic libraries, or gel slices containing a genomic DNA restriction digest, is not to be considered an isolated nucleic acid.

"Modulation" of the level of a compound or constituent refers to the change in the level of the indicated compound or constituent that is observed as a result of expression of, or transcription from, an exogenous nucleic acid in a plant cell. The change in level is measured relative to the corresponding level in control plants.

"Nucleic acid" and "polynucleotide" are used interchangeably herein, and refer to both RNA and DNA, including cDNA, genomic DNA, synthetic DNA, and DNA or RNA containing nucleic acid analogs. Polynucleotides can have any three-dimensional structure. A nucleic acid can be double-stranded or single-stranded (i.e., a sense strand or an antisense strand). Non-limiting examples of polynucleotides include genes, gene fragments, exons, introns, messenger RNA (mRNA), transfer RNA, ribosomal RNA, siRNA, micro-RNA, ribozymes, cDNA, recombinant polynucleotides, branched polynucleotides, nucleic acid probes and nucleic acid primers. A polynucleotide may contain unconventional or modified nucleotides.

"Operably linked" refers to the positioning of a regulatory region and a sequence to be transcribed in a nucleic acid so that the regulatory region is effective for regulating transcription or translation of the sequence. For example, to operably link a coding sequence and a regulatory region, the translation initiation site of the translational reading frame of the coding sequence is typically positioned between one and about fifty nucleotides downstream of the regulatory region. A regulatory region can, however, be positioned as much as about 5,000 nucleotides upstream of the translation initiation site, or about 2,000 nucleotides upstream of the transcription start site.

"Polypeptide" as used herein refers to a compound of two or more subunit amino acids, amino acid analogs, or other peptidomimetics, regardless of post-translational modification, e.g., phosphorylation or glycosylation. The subunits may be linked by peptide bonds or other bonds such as, for example, ester or ether bonds. Full-length polypeptides, truncated polypeptides, point mutants, insertion mutants, splice variants, chimeric proteins, and fragments thereof are encompassed by this definition.

"Progeny" includes descendants of a particular plant or plant line. Progeny of an instant plant include seeds formed on $F_1$, $F_2$, $F_3$, $F_4$, $F_5$, $F_6$ and subsequent generation plants, or seeds formed on $BC_1$, $BC_2$, $BC_3$, and subsequent generation plants, or seeds formed on $F_1BC_1$, $F_1BC_2$, $F_1BC_3$, and subsequent generation plants. The designation $F_1$ refers to the progeny of a cross between two parents that are genetically distinct. The designations $F_2$, $F_3$, $F_4$, $F_5$ and $F_6$ refer to subsequent generations of self- or sib-pollinated progeny of an $F_1$ plant.

"Regulatory region" refers to a nucleic acid having nucleotide sequences that influence transcription or translation initiation and rate, and stability and/or mobility of a transcription or translation product. Regulatory regions include, without limitation, promoter sequences, enhancer sequences, response elements, protein recognition sites, inducible elements, protein binding sequences, 5' and 3' untranslated regions (UTRs), transcriptional start sites, termination sequences, polyadenylation sequences, introns, and combinations thereof. A regulatory region typically comprises at least a core (basal) promoter. A regulatory region also may include at least one control element, such as an enhancer sequence, an upstream element or an upstream activation region (UAR). For example, a suitable enhancer is a cis-regulatory element (−212 to −154) from the upstream region of the octopine synthase (ocs) gene. Fromm et al., *The Plant Cell,* 1:977-984 (1989).

"Up-regulation" refers to regulation that increases the level of an expression product (mRNA, polypeptide, or both) relative to basal or native states.

"Vector" refers to a replicon, such as a plasmid, phage, or cosmid, into which another DNA segment may be inserted so as to bring about the replication of the inserted segment. Generally, a vector is capable of replication when associated with the proper control elements. The term "vector" includes cloning and expression vectors, as well as viral vectors and integrating vectors. An "expression vector" is a vector that includes a regulatory region.

Oxidative stress: Plant species vary in their capacity to tolerate ROS/ROI/AOS. "Oxidative stress" can be defined as the set of environmental conditions under which a plant will begin to suffer the effects of elevated ROS/ROI/AOS concentration, such as decreases in enzymatic activity, DNA breakage, DNA-protein crosslinking, necrosis and stunted growth. For these reasons, plants experiencing oxidative stress typically exhibit a significant reduction in biomass and/or yield.

Elevated oxidative stress may be caused by natural, geological processes and by human activities, such as pollution. Since plant species vary in their capacity to tolerate oxidative stress, the precise environmental conditions that cause stress cannot be generalized. However, under oxidative stress conditions, oxidative stress tolerant plants produce higher biomass, yield and survivorship than plants that are not oxidative stress tolerant. Differences in physical appearance, recovery and yield can be quantified Photosynthetic efficiency: photosynthetic efficiency, or electron transport via photosystem II, is estimated by the relationship between Fm, the maximum fluorescence signal and the variable fluorescence, Fv. A reduction in the optimum quantum yield (Fv/Fm) indicates stress and can be used to monitor the performance of transgenic plants compared to non-transgenic plants under salt or oxidative stress conditions.

Salicylic Acid Growth Index (SAGI): Photosynthetic efficiency×seedling area.

Salt growth index (SGI): Photosynthetic efficiency×seedling area (under salinity stress condition).

Salinity: Plant species vary in their capacity to tolerate salinity. "Salinity" can be defined as the set of environmental conditions under which a plant will begin to suffer the effects of elevated salt concentration, such as ion imbalance, decreased stomatal conductance, decreased photosynthesis, decreased growth rate, increased cell death, loss of turgor (wilting), or ovule abortion. For these reasons, plants experiencing salinity stress typically exhibit a significant reduction in biomass and/or yield.

Elevated salinity may be caused by natural, geological processes and by human activities, such as pollution. Since plant species vary in their capacity to tolerate salinity, the precise environmental conditions that cause stress cannot be generalized. However, under saline conditions, salinity tolerant plants produce higher biomass, yield and survivorship than plants that are not saline tolerant. Differences in physical appearance, recovery and yield can be quantified.

Elevated salinity may be caused by natural, geological processes and by human activities, such as irrigation. Since plant species vary in their capacity to tolerate water deficit, the precise environmental salt conditions that cause stress cannot be generalized. However, under saline conditions, salt tolerant plants produce higher biomass, yield and survivorship than plants that are not salt tolerant. Differences in physical appearance, recovery and yield can be quantified and statistically analyzed using well known measurement and analysis methods.

II. Polypeptides

Polypeptides described herein include salinity tolerance and/or oxidative stress tolerance-modulating polypeptides. Salinity tolerance and/or oxidative stress tolerance—modulating polypeptides can be effective to modulate salinity tolerance and/or oxidative stress tolerance levels when expressed in a plant or plant cell. Such polypeptides typically contain at least one domain indicative of salinity tolerance and/or oxidative stress tolerance-modulating polypeptides, as described in more detail herein. Salinity tolerance and/or oxidative stress tolerance-modulating polypeptides typically have an HMM bit score that is greater than 30, as described in more detail herein. In some embodiments, salinity tolerance and/or oxidative stress tolerance-modulating polypeptides have greater than 85% identity to SEQ ID NOs: 2, 4, 6, 8, 9, 11, 13, 14, 15, 17, 19, 20, 22, 23, 24, 25, 27, 29, 30, 31, 33, 35, 36, 37, 38, 39, 41, 42, 43, 44, 45, 47, 49, 50, 52, 54, 56, 58, 60, 62, 63, 64, 66, 68, 69, 71, 73, 74, 76, 78, 80, 81, 83, 84, 86, 88, 90, 91, 93, 94, 96, 98, 100, 101, 102, 104, 106, 107, 109, 110, 112, 114, 116, 118, 119, 121, 122, 123, 125, 126, 127, 128, 129, 130, 132, 134, 136, 138, 140, 141, 142, 143, 144, 145, 147, 149, 151, 153, 154, 156, 158, 160, 162, 163, 165, 166, 167, 168, and amino acid coordinates 1 to 135 of SEQ ID NO: 138 as described in more detail herein.

A. Domains Indicative of Salinity Tolerance and/or Oxidative Stress Tolerance—Modulating Polypeptides A salinity tolerance and/or oxidative stress tolerance-modulating polypeptide can contain an IQ calmodulin-binding motif domain, which is predicted to be characteristic of an salinity tolerance and/or oxidative stress tolerance-modulating polypeptide. Calmodulin (CaM) is recognized as a major calcium sensor and orchestrator of regulatory events through its interaction with a diverse group of cellular proteins. Three classes of recognition motifs exist for many of the known CaM binding proteins; the IQ motif as a consensus for Ca2+-independent binding and two related motifs for Ca2+-dependent binding, termed 18-14 and 1-5-10 based on the position of conserved hydrophobic residues PUBMED:9141499.

For example, the regulatory domain of scallop myosin is a three-chain protein complex that switches on this motor in response to Ca2+ binding. Side-chain interactions link the two light chains in tandem to adjacent segments of the heavy chain bearing the IQ-sequence motif. The Ca2+-binding site is a novel EF-hand motif on the essential light chain and is stabilized by linkages involving the heavy chain and both light chains, accounting for the requirement of all three chains for Ca2+ binding and regulation in the intact myosin molecule PUB MED: 8127365.

For example, SEQ ID NO:86 sets forth the amino acid sequence of an *Arabidopsis* clone, identified herein as Ceres SEEDLINE ID no. ME08768, that is predicted to encode a polypeptide containing a IQ calmodulin-binding motif domain from residues 116-136.

In some embodiments, a salinity tolerance and/or oxidative stress tolerance-modulating polypeptide is truncated at the amino- or carboxyl-terminal end of a naturally occurring polypeptide. A truncated polypeptide may retain certain domains of the naturally occurring polypeptide while lacking others. Thus, length variants that are up to 5 amino acids shorter or longer typically exhibit the salinity tolerance and/or oxidative stress tolerance-modulating activity of a truncated polypeptide. In some embodiments, a truncated polypeptide is a dominant negative polypeptide. SEQ ID NO: 140 sets forth the amino sequence of a salinity tolerance and/or oxidative stress tolerance-modulating polypeptide that is truncated at the 5' end relative to the naturally occurring polypeptide. Expression in a plant of such a truncated polypeptide confers a difference in the level of salinity tolerance and/or oxidative stress tolerance in a plant and/or plant tissue as compared to the corresponding level a control plant and/or tissue thereof that does not comprise the truncation.

B. Functional Homologs Identified by Reciprocal BLAST

In some embodiments, one or more functional homologs of a reference salinity tolerance and/or oxidative stress tolerance-modulating polypeptide defined by one or more of the pfam descriptions indicated above are suitable for use as salinity tolerance and/or oxidative stress tolerance-modulating polypeptides. A functional homolog is a polypeptide that has sequence similarity to a reference polypeptide, and that carries out one or more of the biochemical or physiological function(s) of the reference polypeptide. A functional homolog and the reference polypeptide may be natural occurring polypeptides, and the sequence similarity may be due to convergent or divergent evolutionary events. As such, functional homologs are sometimes designated in the literature as homologs, or orthologs, or paralogs. Variants of a naturally occurring functional homolog, such as polypeptides encoded by mutants of a wild type coding sequence, may themselves be functional homologs. Functional homologs can also be created via site-directed mutagenesis of the coding sequence for a salinity tolerance and/or oxidative stress tolerance-modulating polypeptide, or by combining domains from the coding sequences for different naturally-occurring salinity tolerance and/or oxidative stress tolerance-modulating polypeptides ("domain swapping"). The term "functional homolog" is sometimes applied to the nucleic acid that encodes a functionally homologous polypeptide.

Functional homologs can be identified by analysis of nucleotide and polypeptide sequence alignments. For example, performing a query on a database of nucleotide or polypeptide sequences can identify homologs of salinity tolerance and/or oxidative stress tolerance-modulating polypeptides. Sequence analysis can involve BLAST, Reciprocal BLAST, or PSI-BLAST analysis of nonredundant databases using a salinity tolerance and/or oxidative stress tolerance-modulating polypeptide amino acid sequence as the reference sequence. Amino acid sequence is, in some instances, deduced from the nucleotide sequence. Those polypeptides in the database that have greater than 40% sequence identity are candidates for further evaluation for suitability as a salinity tolerance and/or oxidative stress tolerance-modulating polypeptide. Amino acid sequence similarity allows for conservative amino acid substitutions, such as substitution of one hydrophobic residue for another or substitution of one polar residue for another. If desired, manual inspection of such candidates can be carried out in order to narrow the number of candidates to be further evaluated. Manual inspection can be performed by selecting those candidates that appear to have domains present in salinity tolerance and/or oxidative stress tolerance-modulating polypeptides, e.g., conserved functional domains.

Conserved regions can be identified by locating a region within the primary amino acid sequence of a salinity tolerance and/or oxidative stress tolerance-modulating polypeptide that is a repeated sequence, forms some secondary structure (e.g., helices and beta sheets), establishes positively or negatively charged domains, or represents a protein motif or domain. See, e.g., the Pfam web site describing consensus sequences for a variety of protein motifs and domains on the World Wide Web at sanger.ac.uk/Software/Pfam/and pfam.janelia.org/. A description of the information included at the Pfam database is described in Sonnhammer et al., *Nucl. Acids Res.*, 26:320-322 (1998); Sonnhammer et al., *Proteins*, 28:405-420 (1997); and Bateman et al., *Nucl. Acids Res.*, 27:260-262 (1999). Conserved regions also can be determined by aligning sequences of the same or related polypeptides from closely related species. Closely related species preferably are from the same family. In some embodiments, alignment of sequences from two different species is adequate.

Typically, polypeptides that exhibit at least about 40% amino acid sequence identity are useful to identify conserved regions. Conserved regions of related polypeptides exhibit at least 45% amino acid sequence identity (e.g., at least 50%, at least 60%, at least 70%, at least 80%, or at least 90% amino acid sequence identity). In some embodiments, a conserved region exhibits at least 92%, 94%, 96%, 98%, or 99% amino acid sequence identity.

Amino acid sequences of functional homologs of the polypeptide set forth in SEQ ID NO: 86 are provided in FIG. 1 and in the Sequence Listing. Such functional homologs include (SEQ ID NO: 88, 90, 91, 93, 94, 96, 98, 100, 101, 102, 104, 106, and 107). In some cases, a functional homolog of SEQ ID NO: 86 has an amino acid sequence with at least 50% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 86.

Figure 2:
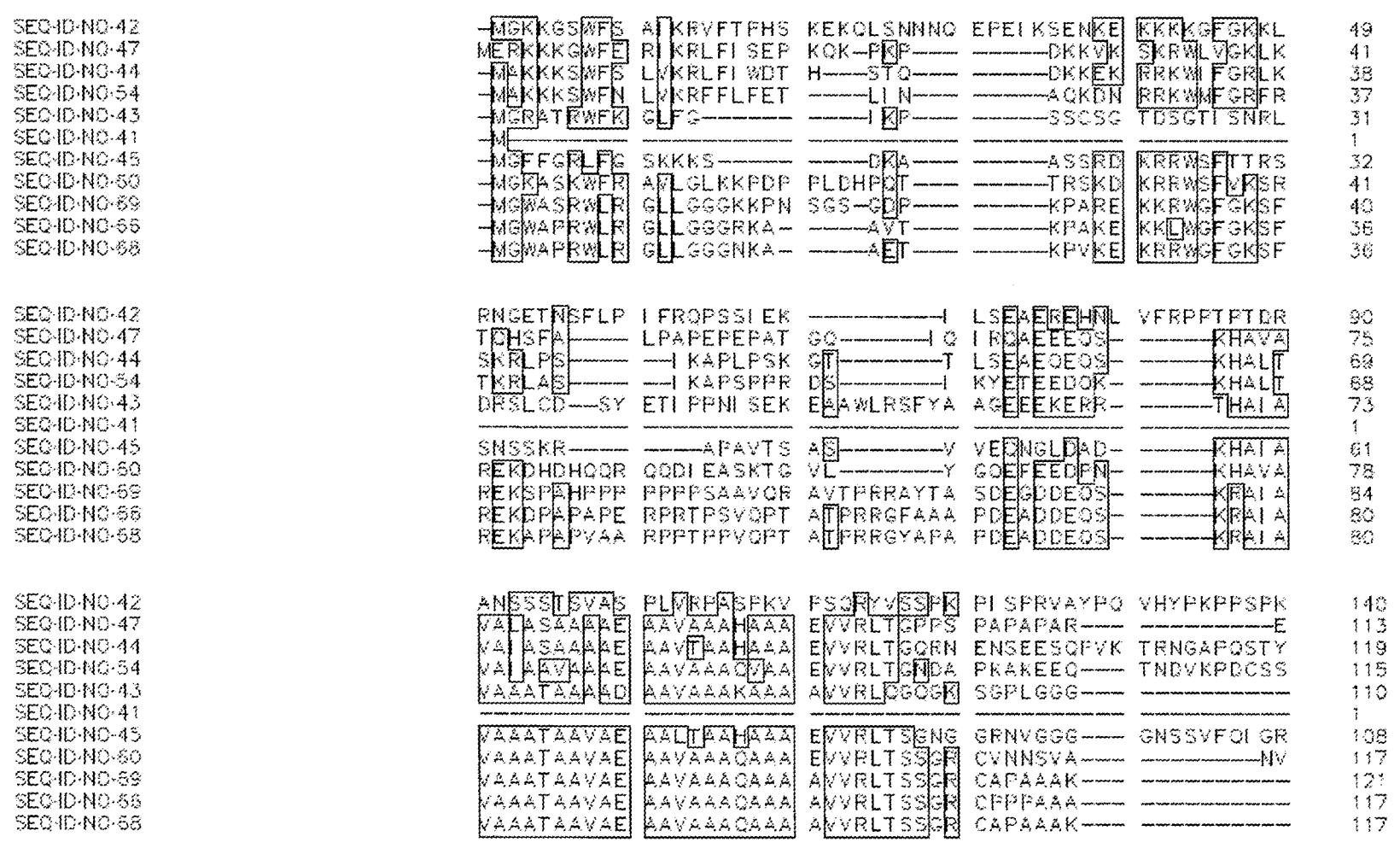
Figure 2:
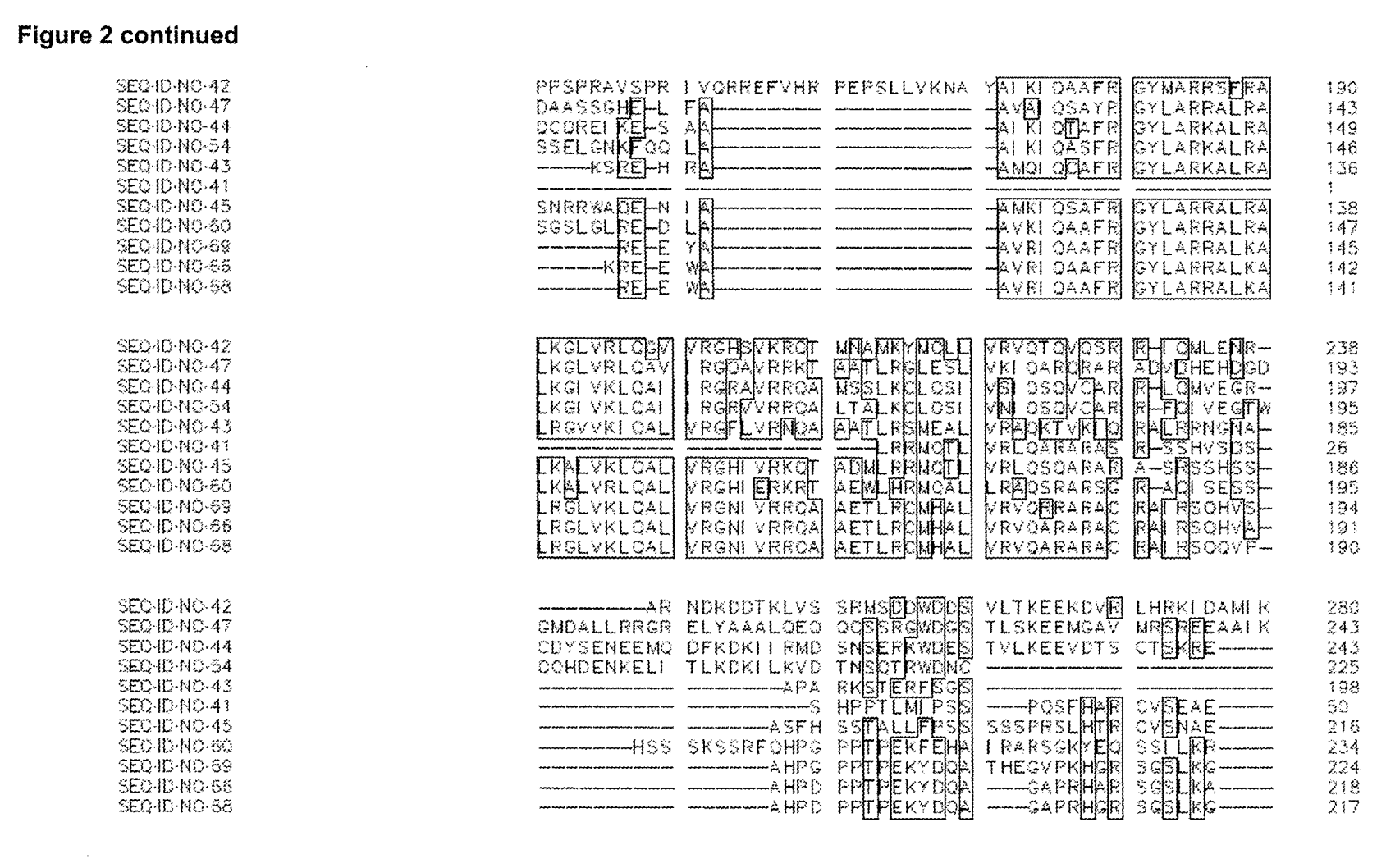
Figure 2:
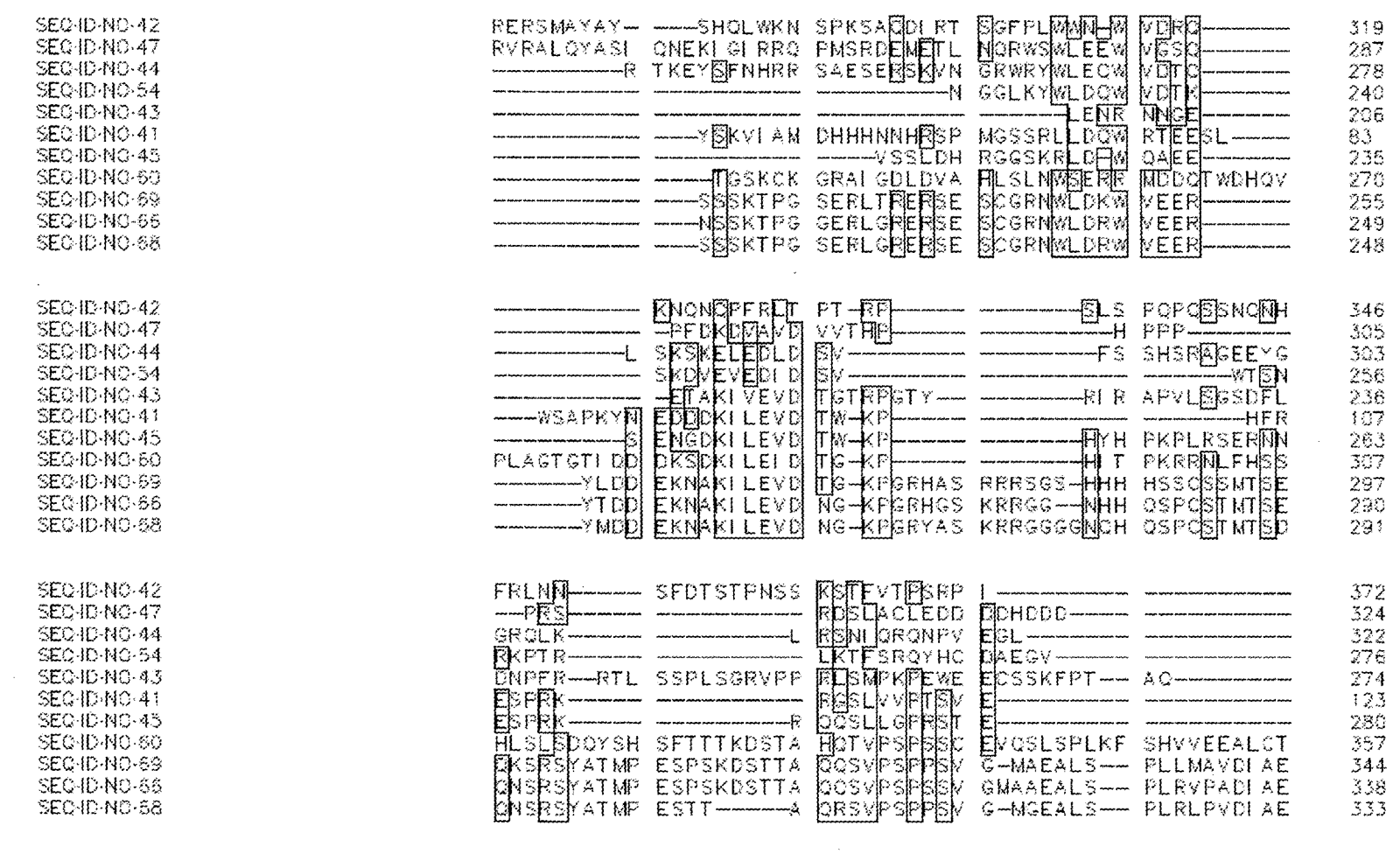

Amino acid sequences of functional homologs of the polypeptide set forth in SEQ ID NO: 41 are provided in FIG. 2. Such functional homologs include (SEQ ID NO: 42, 43, 44, 45, 47, 49, 50, 52, 54, 56, 58, 60, 62, 63, 64, 66, 68, 69, 71, 73, 74, 76, 78, 80, 81, 83, and 84). In some cases, a functional homolog of SEQ ID NO: 41 has an amino acid sequence with at least 50% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 41.

Amino acid sequences of functional homologs of the polypeptide set forth in SEQ ID NO: 109 are provided in FIG. 3. Such functional homologs include (SEQ ID NO: 110, 112, 114, 116, 118, 119, 121, 122, 123, 125, 126, 127, 128, 129, 130, 132, and 134). In some cases, a functional homolog of SEQ ID NO: 109 has an amino acid sequence with at least 50% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 109.

Amino acid sequences of functional homologs of the polypeptide set forth in SEQ ID NO:138 are provided in FIG. 4. Such functional homologs include (SEQ ID NO: 136, 140, 141, 142, 143, 144, 145, 147, 149, 151, 153, 154, 156, 158, 160, 162, 163, 165, 166, 167, and 168). In some cases, a functional homolog of SEQ ID NO: 138 has an amino acid sequence with at least 50% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 138.

Figure 5:
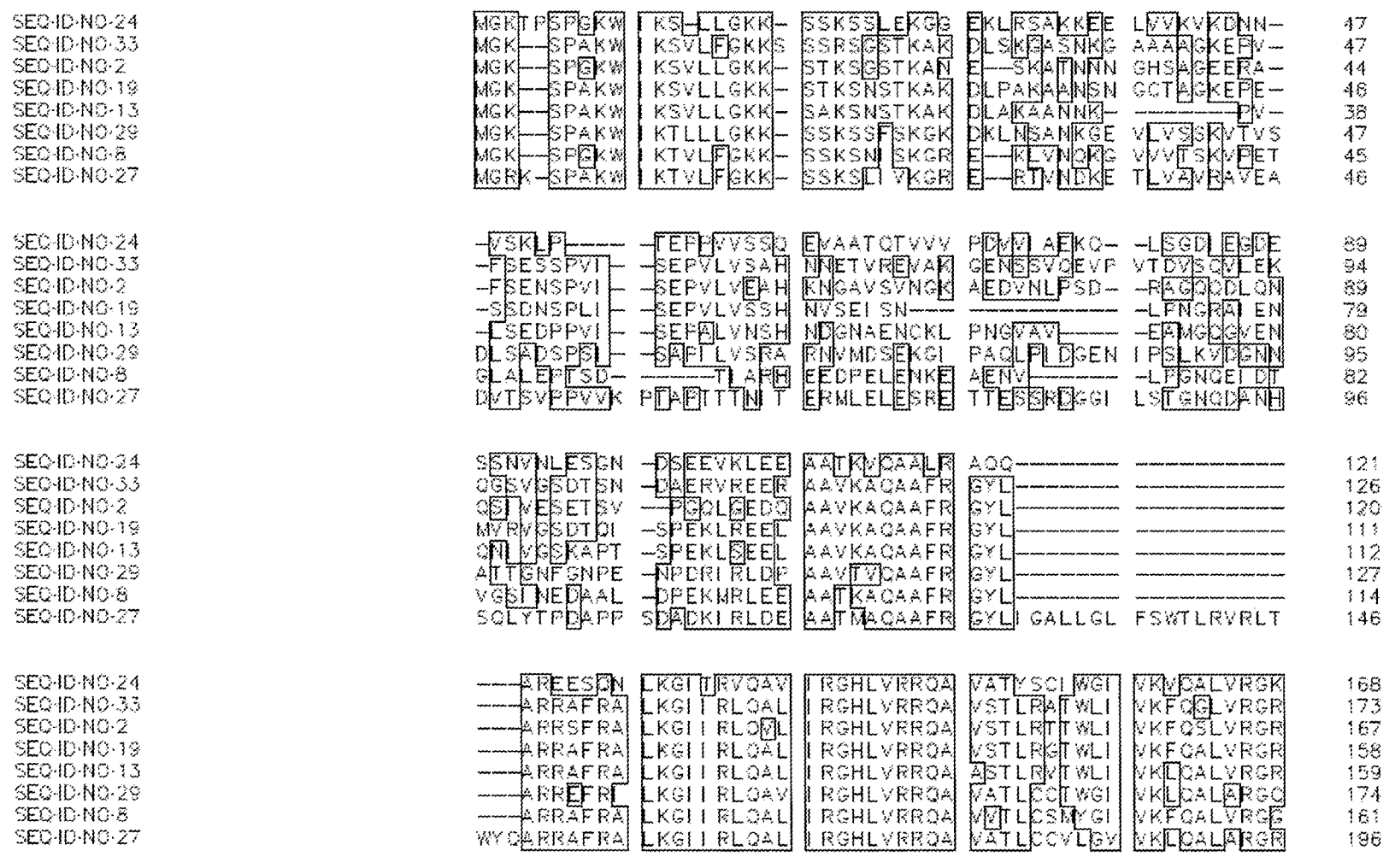
Figure 5:
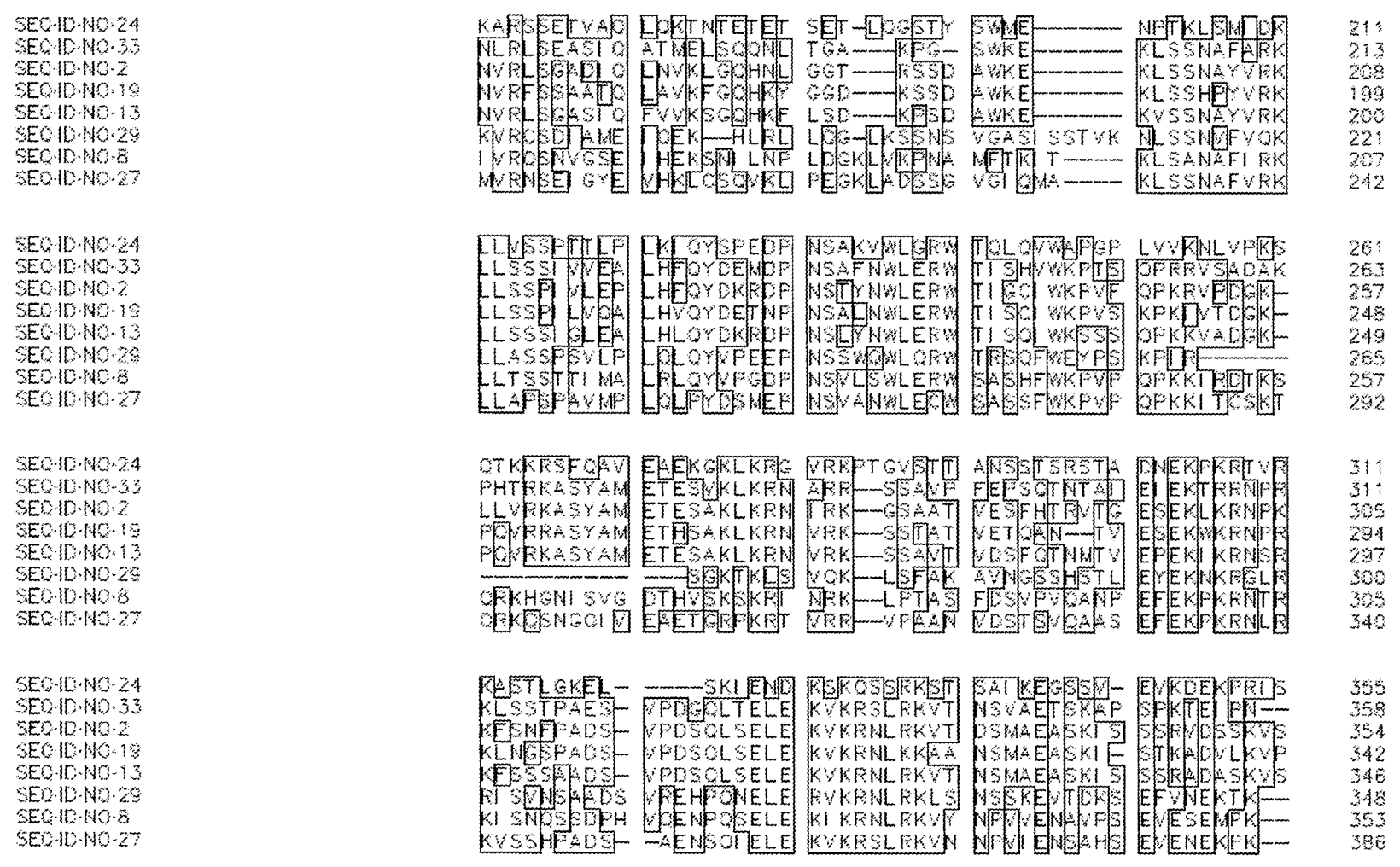
Figure 5:
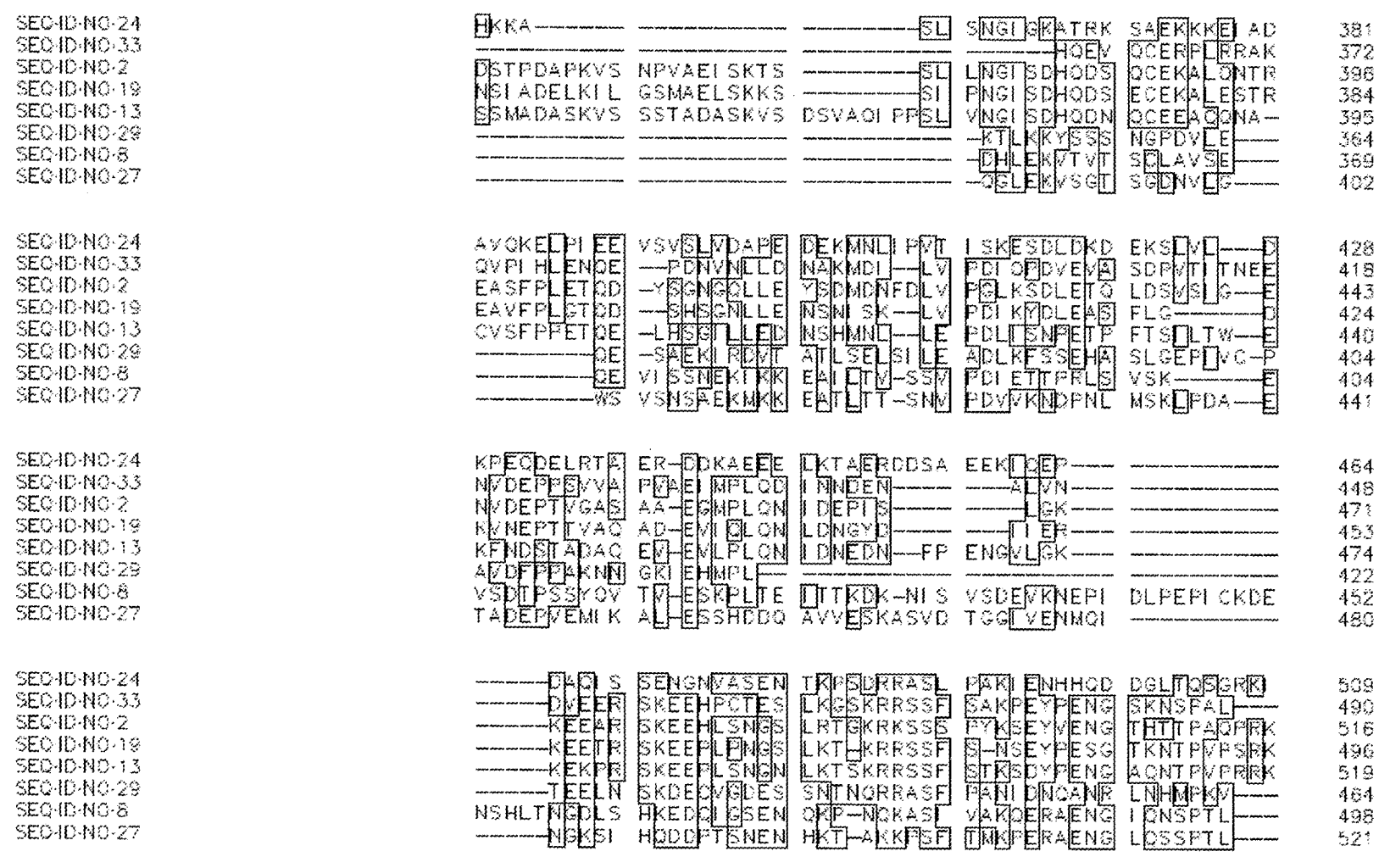

Amino acid sequences of functional homologs of the polypeptide set forth in SEQ ID NO: 2 are provided in FIG. 5. Such functional homologs include (SEQ ID NO: 2, 4, 6, 8, 9, 11, 13, 14, 15, 17, 19, 20, 22, 23, 24, 25, 27, 29, 30, 31, and 33). In some cases, a functional homolog of SEQ ID NO: 2 has an amino acid sequence with at least 50% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 2.

Amino acid sequences of functional homologs of the polypeptide set forth in SEQ ID NO: 35 are provided in FIG. 6. Such functional homologs include (SEQ ID NO: 35, 36, 37, 38, and 39). In some cases, a functional homolog of SEQ ID NO: 35 has an amino acid sequence with at least 50% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 35.

The identification of conserved regions in a salinity tolerance and/or oxidative stress tolerance-modulating polypeptide facilitates production of variants of salinity tolerance and/or oxidative stress tolerance-modulating polypeptides. Variants of salinity tolerance and/or oxidative stress tolerance-modulating polypeptides typically have 10 or fewer conservative amino acid substitutions within the primary amino acid sequence, e.g., 7 or fewer conservative amino acid substitutions, 5 or fewer conservative amino acid substitutions, or between 1 and 5 conservative substitutions. A useful variant polypeptide can be constructed based on one of the alignments set forth in FIGS. 1 thru 6. Such a polypeptide includes the conserved regions, arranged in the order depicted in the Figure from amino-terminal end to carboxy-terminal end. Such a polypeptide may also include zero, one, or more than one amino acid in positions marked by dashes. When no amino acids are present at positions marked by dashes, the length of such a polypeptide is the sum of the amino acid residues in all conserved regions. When amino acids are present at all positions marked by dashes, such a polypeptide has a length that is the sum of the amino acid residues in all conserved regions and all dashes.

C. Functional Homologues Identified by HMM

In some embodiments, useful salinity and/or oxidative stress tolerance-modulating polypeptides include those that fit a Hidden Markov Model based on the polypeptides set forth in any one of FIGS. 1-6. A Hidden Markov Model (HMM) is a statistical model of a consensus sequence for a group of functional homologs. See, Durbin et al., *Biological Sequence Analysis Probabilistic Models of Proteins and Nucleic Acids*, Cambridge University Press, Cambridge, UK (1998). An HMM is generated by the program HMMER 2.3.2 with default program parameters, using the sequences of the group of functional homologs as input. The multiple sequence alignment is generated by ProbCons (Do et al., Genome Res., 15(2):330-40 (2005)) version 1.11 using a set of default parameters: -c, —consistency REPS of 2; -ir, —iterative-refinement REPS of 100; -pre, —pre-training REPS of 0. ProbCons is a public domain software program provided by Stanford University.

The default parameters for building an HMM (hmmbuild) are as follows: the default "architecture prior" (archpri) used by MAP architecture construction is 0.85, and the default cutoff threshold (idlevel) used to determine the effective sequence number is 0.62. HMMER 2.3.2 was released Oct. 3, 2003 under a GNU general public license, and is available from various sources on the World Wide Web. Hmmbuild outputs the model as a text file.

The HMM for a group of functional homologs can be used to determine the likelihood that a candidate salinity tolerance and/or oxidative stress tolerance-modulating polypeptide sequence is a better fit to that particular HMM than to a null HMM generated using a group of sequences that are not structurally or functionally related. The likelihood that a subject polypeptide sequence is a better fit to an HMM than to a null HMM is indicated by the HMM bit score, a number generated when the candidate sequence is fitted to the HMM profile using the HMMER hmmsearch program. The following default parameters are used when running hmmsearch: the default E-value cutoff (E) is 10.0, the default bit score cutoff (T) is negative infinity, the default number of sequences in a database (Z) is the real number of sequences in the database, the default E-value cutoff for the per-domain ranked hit list (domE) is infinity, and the default bit score cutoff for the per-domain ranked hit list (domT) is negative infinity. A high HMM bit score indicates a greater likelihood that the subject sequence carries out one or more of the biochemical or physiological function(s) of the polypeptides used to generate the HMM. A high HMM bit score is at least 20, and often is higher.

As those of skill in the art would appreciate, the HMM scores provided in the sequence listing are merely exemplary. Since multiple sequence alignment algorithms, such as ProbCons, can only generate near-optimal results, slight variations of the model can arise due to factors such as the order in which sequences are processed for alignment. Nevertheless, HMM score variability is minor, and so the HMM scores in the sequence listing are representative of models made with the respective sequences.

The salinity and/or oxidative stress-modulating polypeptides discussed below fit the indicated HMM with an HMM bit score greater than 20 (e.g., greater than 20, 30, 40, 50, 60, 70, 80, 90, 100, 200, 300, 400, or 500). In some embodiments, the HMM bit score of a salinity and/or oxidative stress-modulating polypeptide discussed below is about 50%, 60%, 70%, 80%, 90%, or 95% of the HMM bit score of a functional homolog provided in the Sequence Listing. In some embodiments, a salinity and/or oxidative stress-modulating polypeptide discussed below fits the indicated HMM with an HMM bit score greater than 20, and has a domain indicative of an salinity and/or oxidative stress-modulating polypeptide. In some embodiments, a salinity and/or oxidative stress-modulating polypeptide discussed below fits the indicated HMM with an HMM bit score greater than 20, and has 85% or greater sequence identity (e.g., 75%, 80%, 85%, 90%, 95%, or 100% sequence identity) to an amino acid sequence shown in any one of FIGS. 1 thru 6 or to an amino acid sequence correlated in the Sequence Listing to a any one of FIGS. 1 thru 6._.

In the Sequence Listing polypeptides are provided that have HMM bit scores greater than 400, 450, 500, 550, 600, 650, 700, 750, 800, 850, 900, 950, 1000, 1050, or 1100, when fitted to an HMM generated from the amino acid sequences set forth in FIG. 1. Such polypeptides include Ceres SEEDLINE ID no. ME08768, Ceres CLONE ID no. 1943807, Ceres ANNOT ID no. 1471392, Public GI ID no. 6715635, Ceres CLONE ID no. 910109, Public GI ID no. 115474509, Ceres CLONE ID no. 1780908, Ceres ANNOT ID no. 1520883, Ceres CLONE ID no. 148018, Public GI ID no. 18378797, Public GI ID no. 21553500, Ceres ANNOT ID no. 1444522, Ceres ANNOT ID no. 146751, and Public GI ID no. 125559938 (SEQ ID NO: 86, 88, 90, 91, 93, 94, 96, 98, 100, 101, 102, 104, 106, and 107)

In the Sequence Listing polypeptides are provided that have HMM bit scores greater than 30, 50, 100, 150, 200, 250, 300, 350, 400, 450, 500, 550, 600, 650, 700, 750, 800, 850, 900, 950, or 1000 when fitted to an HMM generated from the amino acid sequences set forth in FIG. 2. Such polypeptides include Ceres SEEDLINE ID no. ME06748, Ceres SEEDLINE ID no. ME20711, Ceres SEEDLINE ID no. ME18973, Ceres SEEDLINE ID no. ME08732, Ceres SEEDLINE ID no. ME19657, Ceres CLONE ID no. 835818, Ceres CLONE ID no. 1796745, Public GI ID no. 125543896, Ceres ANNOT ID no. 1483984, Ceres CLONE ID no. 1924654, Ceres ANNOT ID no. 1468861, Ceres CLONE ID no. 1641776, Ceres ANNOT ID no. 1438750, Ceres ANNOT ID no. 1447395, Public GI ID no. 79482785, Public GI ID no. 3292832, Ceres CLONE ID no. 1559074, Ceres CLONE ID no. 1726548, Public GI ID no. 115459996, Ceres CLONE ID no. 697034, Ceres CLONE ID no. 353438, Public GI ID no. 125593074, Ceres CLONE ID no. 1920115, Ceres CLONE ID no. 21821, Ceres CLONE ID no. 560066, Public GI ID no. 115453071, Ceres CLONE ID no. 1968211, and Public GI ID no. 116310011 $_{13}$ (SEQ ID NO: 42, 43, 44, 45, 47, 49, 50, 52, 54, 56, 58, 60, 62, 63, 64, 66, 68, 69, 71, 73, 74, 76, 78, 80, 81, 83, and 84).

In the Sequence Listing polypeptides are provided that have HMM bit scores greater than 120, 150, 200, 250, 300, 350, 400, 450, 500, 550, 600, 650, 700, 750, 800, 850, 900, 950, 1000, 1050, 1100, 1150, or 1200 when fitted to an HMM generated from the amino acid sequences set forth in FIG. 3. Such polypeptides include Ceres SEEDLINE ID no. ME19173, Public GI ID no. 115435054, Ceres CLONE ID no. 1847857, Ceres ANNOT ID no. 1455219, Ceres CLONE ID no. 352452, Ceres CLONE ID no. 787908, Ceres LOCUS ID no. Os01m00929_AP002743, Ceres CLONE ID no. 246398, Public GI ID no. 125527441, Public GI ID no. 125595056, Ceres CLONE ID no. 236071, Public GI ID no. 125524760, Public GI ID no. 125569365, Public GI ID no. 115439499, Public GI ID no. 15225258, Public GI ID no. 115465173, Ceres ANNOT ID no. 1477059, and Ceres ANNOT ID no. 1530547 (SEQ ID NO: 110, 112, 114, 116, 118, 119, 121, 122, 123, 125, 126, 127, 128, 129, 130, 132, and 134).

In the Sequence Listing polypeptides are provided that have HMM bit scores greater than 150, 200, 250, 300, 350, 400, 450, 500, 550, 600, 650, 700, 750, 800, 850, 900, 950, 1000, 1050, 1100, 1150, 1200, 1250, 1300, or 1350 when fitted to an HMM generated from the amino acid sequences set forth in FIG. 4. Such polypeptides include Ceres SEEDLINE ID no. ME24091, Ceres CLONE ID no. 375578, Ceres CLONE ID no. 375578, Ceres SEEDLINE ID no. ME10681, Ceres SEEDLINE ID no. ME03140, Ceres SEEDLINE ID no. ME24076, Ceres SEEDLINE ID no. ME24217, Public GI ID no. 115440873, Ceres CLONE ID no. 826796, Ceres ANNOT ID no. 1465047, Ceres CLONE ID no. 1919901, Ceres CLONE ID no. 520008, Public GI ID no. 7413581, Ceres CLONE ID no. 228069, Ceres CLONE ID no. 467508, Ceres CLONE ID no. 1829581, Ceres CLONE ID no. 229668, Public GI ID no. 125550655, Ceres CLONE ID no. 106263, Public GI ID no. 15231175, Public GI ID no. 145357576, and Public GI ID no. 125528277 (SEQ ID NO: 136, 138, 140, 141, 142, 143, 144, 145, 147, 149, 151, 153, 154, 156, 158, 160, 162, 163, 165, 166, 167, and 168).

In the Sequence Listing polypeptides are provided that have HMM bit scores greater than 425, 450, 500, 550, 600, 650, 700, 750, 800, 850, 900, 950, 1000, 1050, 1100, 1150, 1200, 1250, 1300, 1350, 1400, 1450, 1500, or 1550, when fitted to an HMM generated from the amino acid sequences set forth in FIG. 5. Such polypeptides include Ceres CLONE ID no. 1792354, Ceres CLONE ID no. 1925477, Ceres ANNOT ID no. 1521592, Ceres CLONE ID no. 463594, Public GI ID no. 22330633, Ceres CLONE ID no. 345954, Ceres LOCUS ID no. Os01 m05025_AP003288, GI ID no. 56784330, Public GI ID no. 125527495, Public GI ID no. 125553119, Ceres CLONE ID no. 236431, Ceres CLONE ID no. 908518, Public GI ID no. 115465121, Ceres CLONE ID no. 1791910, Public GI ID no. 125595019, Public GI ID no. 42568886, Public GI ID no. 2947062, Ceres ANNOT ID no. 1468228, Ceres CLONE ID no. 1942388, Public GI ID no. 12324824, Public GI ID no. 5882749, and Ceres CLONE ID no. 325403 (SEQ ID NO: 2, 4, 6, 8, 9, 11, 13, 14, 15, 17, 19, 20, 22, 23, 24, 25, 27, 29, 30, 31, and 33).

In the Sequence Listing polypeptides are provided that have HMM bit scores greater than 550, 600, 650, or 700 when fitted to an HMM generated from the amino acid sequences set forth in FIG. 6. Such polypeptides include Ceres GI ID no. 56784328, Public GI ID no. 56784330, Public GI ID no. 125528718, Public GI ID no. 125572975, and Public GI ID no. 125528716 (SEQ ID NO: 35, 36, 37, 38, and 39).

D. Percent Identity

In some embodiments, a salinity and/or oxidative stress tolerance-modulating polypeptide has an amino acid sequence with at least 50% sequence identity, e.g., 50%, 52%, 56%, 59%, 61%, 65%, 70%, 75%, 80%, 85%, 90%, 95%, 97%, 98%, or 99% sequence identity, to one of the amino acid sequences set forth in SEQ ID NOs: 2, 4, 6, 8, 9, 11, 13, 14, 15, 17, 19, 20, 22, 23, 24, 25, 27, 29, 30, 31, 33, 35, 36, 37, 38, 39, 41, 42, 43, 44, 45, 47, 49, 50, 52, 54, 56, 58, 60, 62, 63, 64, 66, 68, 69, 71, 73, 74, 76, 78, 80, 81, 83, 84, 86, 88, 90, 91, 93, 94, 96, 98, 100, 101, 102, 104, 106, 107, 109, 110, 112, 114, 116, 118, 119, 121, 122, 123, 125, 126, 127, 128, 129, 130, 132, 134, 136, 138, 140, 141, 142, 143, 144, 145, 147, 149, 151, 153, 154, 156, 158, 160, 162, 163, 165, 166, 167, 168, and amino acid coordinates 1 to 135 of SEQ ID NO: 138. Polypeptides having such a percent sequence identity often have a domain indicative of a salinity and/or oxidative stress-modulating polypeptide and/or have an HMM bit score that is greater than 20, as discussed above. Examples of amino acid sequences of salinity and/or oxidative stress tolerance-modulating polypeptides having at least 85% sequence identity to one of the amino acid sequences set forth in SEQ ID NOs: 2, 4, 6, 8, 9, 11, 13, 14, 15, 17, 19, 20, 22, 23, 24, 25, 27, 29, 30, 31, 33, 35, 36, 37, 38, 39, 41, 42, 43, 44, 45, 47, 49, 50, 52, 54, 56, 58, 60, 62, 63, 64, 66, 68, 69, 71, 73, 74, 76, 78, 80, 81, 83, 84, 86, 88, 90, 91, 93, 94, 96, 98, 100, 101, 102, 104, 106, 107, 109, 110, 112, 114, 116, 118, 119, 121, 122, 123, 125, 126, 127, 128, 129, 130, 132, 134, 136, 138, 140, 141, 142, 143, 144, 145, 147, 149, 151, 153, 154, 156, 158, 160, 162, 163, 165, 166, 167, 168, and amino acid coordinates 1 to 135 of SEQ ID NO: 138 are provided in FIGS. 1-6.

"Percent sequence identity" refers to the degree of sequence identity between any given reference sequence, e.g., SEQ ID NOs: 2, 4, 6, 8, 9, 11, 13, 14, 15, 17, 19, 20, 22, 23, 24, 25, 27, 29, 30, 31, 33, 35, 36, 37, 38, 39, 41, 42, 43, 44, 45, 47, 49, 50, 52, 54, 56, 58, 60, 62, 63, 64, 66, 68, 69, 71, 73, 74, 76, 78, 80, 81, 83, 84, 86, 88, 90, 91, 93, 94, 96, 98, 100, 101, 102, 104, 106, 107, 109, 110, 112, 114, 116, 118, 119, 121, 122, 123, 125, 126, 127, 128, 129, 130, 132, 134, 136, 138, 140, 141, 142, 143, 144, 145, 147, 149, 151, 153, 154, 156, 158, 160, 162, 163, 165, 166, 167, 168, and amino acid coordinates 1 to 135 of SEQ ID NO: 138, and a candidate salinity and/or oxidative stress-modulating sequence. A candidate sequence typically has a length that is from 80 percent to 200 percent of the length of the reference sequence, e.g., 82, 85, 87, 89, 90, 93, 95, 97, 99, 100, 105, 110, 115, 120, 130, 140, 150, 160, 170, 180, 190, or 200 percent of the length of the reference sequence. A percent identity for any candidate nucleic acid or polypeptide relative to a reference nucleic acid or polypeptide can be determined as follows. A reference sequence (e.g., a nucleic acid sequence or an amino acid sequence) is aligned to one or more candidate sequences using the computer program ClustalW (version 1.83, default parameters), which allows alignments of nucleic acid or polypeptide sequences to be carried out across their entire length (global alignment). Chenna et al., Nucleic Acids Res., 31(13):3497-500 (2003).

ClustalW calculates the best match between a reference and one or more candidate sequences, and aligns them so that identities, similarities and differences can be determined Gaps of one or more residues can be inserted into a reference sequence, a candidate sequence, or both, to maximize sequence alignments. For fast pairwise alignment of nucleic acid sequences, the following default parameters are used: word size: 2; window size: 4; scoring method: percentage; number of top diagonals: 4; and gap penalty: 5. For multiple alignment of nucleic acid sequences, the following parameters are used: gap opening penalty: 10.0; gap extension penalty: 5.0; and weight transitions: yes. For fast pairwise alignment of protein sequences, the following parameters are used: word size: 1; window size: 5; scoring method: percentage; number of top diagonals: 5; gap penalty: 3. For multiple alignment of protein sequences, the following parameters are used: weight matrix: blosum; gap opening penalty: 10.0; gap extension penalty: 0.05; hydrophilic gaps: on; hydrophilic residues: Gly, Pro, Ser, Asn, Asp, Gln, Glu, Arg, and Lys; residue-specific gap penalties: on. The ClustalW output is a sequence alignment that reflects the relationship between sequences. ClustalW can be run, for example, at the Baylor College of Medicine Search Launcher site (searchlauncher.bcm.tmc.edu/multi-align/multi-align.html) and at the European Bioinformatics Institute site on the World Wide Web (ebi.ac.uk/clustalw).

To determine percent identity of a candidate nucleic acid or amino acid sequence to a reference sequence, the sequences are aligned using ClustalW, the number of identical matches in the alignment is divided by the length of the reference sequence, and the result is multiplied by 100. It is noted that the percent identity value can be rounded to the nearest tenth. For example, 78.11, 78.12, 78.13, and 78.14 are rounded down to 78.1, while 78.15, 78.16, 78.17, 78.18, and 78.19 are rounded up to 78.2.

In some cases, a salinity and/or oxidative stress tolerance-modulating polypeptide has an amino acid sequence with at least 50% sequence identity, e.g., 50%, 52%, 56%, 59%, 61%, 65%, 70%, 75%, 80%, 85%, 90%, 95%, 97%, 98%, or 99% sequence identity, to one or more of the amino acid sequence set forth in SEQ ID NO: 86 Amino acid sequences of polypeptides having high sequence identity to the polypeptide set forth in SEQ ID NO: 86 are provided in the Sequence Listing. Such polypeptides include SEQ ID NO: 88, 90, 91, 93, 94, 96, 98, 100, 101, 102, 104, 106, and 107.

In some cases, a salinity and/or oxidative stress tolerance-modulating polypeptide has an amino acid sequence with at least 50% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 41. Amino acid sequences of polypeptides having high sequence identity to the polypeptide set forth in SEQ ID NO: 41 are provided in the Sequence Listing. Such polypeptides include SEQ ID NO: 42, 43, 44, 45, 47, 49, 50, 52, 54, 56, 58, 60, 62, 63, 64, 66, 68, 69, 71, 73, 74, 76, 78, 80, 81, 83, and 84.

In some cases, a salinity and/or oxidative stress-modulating polypeptide has an amino acid sequence with at least 50% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 109. Amino acid sequences of polypeptides having high sequence identity to the polypeptide set forth in SEQ ID NO: 109 are provided in the Sequence Listing. Such polypeptides include SEQ ID NO: 110, 112, 114, 116, 118, 119, 121, 122, 123, 125, 126, 127, 128, 129, 130, 132, and 134.

In some cases, a salinity and/or oxidative stress-modulating polypeptide has an amino acid sequence with at least 50% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 138. Amino acid sequences of polypeptides having high sequence identity to the polypeptide set forth in SEQ ID NO: 138 are provided in the Sequence Listing. Such polypeptides include SEQ ID NO: 136, 138, 141, 142, 143, 144, 145, 147, 149, 151, 153, 154, 156, 158, 160, 162, 163, 165, 166, 167, and 168.

In some cases, a salinity and/or oxidative stress-modulating polypeptide has an amino acid sequence with at least 50% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 2. Amino acid sequences of polypeptides having high sequence identity to the polypeptide set forth in SEQ ID NO: 2 are provided in the Sequence Listing. Such polypeptides include SEQ ID NO: 4, 6, 8, 9, 11, 13, 14, 15, 17, 19, 20, 22, 23, 24, 25, 27, 29, 30, 31, and 33.

In some cases, a salinity and/or oxidative stress-modulating polypeptide has an amino acid sequence with at least 50% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 35. Amino acid sequences of polypeptides having high sequence identity to the polypeptide set forth in SEQ ID NO: 35 are provided in the Sequence Listing. Such polypeptides include SEQ ID NO: 36, 37, 38, and 39.

E. Other Sequences

It should be appreciated that a salinity and/or oxidative stress tolerance-modulating polypeptide can include additional amino acids that are not involved in salinity and/or oxidative stress tolerance modulation, and thus such a polypeptide can be longer than would otherwise be the case. For example, a salinity and/or oxidative stress-tolerance modulating polypeptide can include a purification tag, a chloroplast transit peptide, an amyloplast transit peptide, a mitochondrial transit peptide, or a leader sequence added to the amino or carboxy terminus. In some embodiments, a salinity and/or oxidative stress-tolerance modulating polypeptide includes an amino acid sequence that functions as a reporter, e.g., a green fluorescent protein or yellow fluorescent protein.

III. Nucleic Acids

Nucleic acids described herein include nucleic acids that are effective to modulate salinity and/or oxidative stress tolerance levels when transcribed in a plant or plant cell. Such nucleic acids include, without limitation, those that encode a salinity and/or oxidative stress tolerance-modulating polypeptide and those that can be used to inhibit expression of a salinity tolerance and/or oxidative stress tolerance-modulating polypeptide via a nucleic acid based method.

A. Nucleic Acids Encoding Salinity Tolerance and/or Oxidative Stress Tolerance-Modulating Polypeptides Nucleic acids encoding salinity tolerance and/or oxidative stress tolerance-modulating polypeptides are described herein. Such nucleic acids include SEQ ID NOs: 1, 3, 5, 7, 10, 12, 16, 18, 21, 26, 28, 32, 34, 40, 46, 48, 51, 53, 55, 57, 59, 61, 65, 67, 70, 72, 75, 77, 79, 82, 85, 87, 89, 92, 95, 97, 99, 103, 105, 108, 111, 113, 115, 117, 120, 124, 131, 133, 135, 137, 139, 146, 148, 150, 152, 155, 157, 159, 161, and 164, as described in more detail below.

A salinity tolerance and/or oxidative stress tolerance-modulating nucleic acid can comprise the nucleotide sequence set forth in SEQ ID NO: 85. Alternatively, a salinity tolerance and/or oxidative stress tolerance-modulating nucleic acid can be a variant of the nucleic acid having the nucleotide sequence set forth in SEQ ID NO: 85. For example, a salinity tolerance and/or oxidative stress tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 85, 87, 89, 92, 95, 97, 99, 103, and 105.

A salinity tolerance and/or oxidative stress tolerance-modulating nucleic acid can comprise the nucleotide sequence set forth in SEQ ID NO: 40. Alternatively, a salinity tolerance and/or oxidative stress tolerance-modulating nucleic acid can be a variant of the nucleic acid having the nucleotide sequence set forth in SEQ ID NO: 40. For example, a salinity tolerance and/or oxidative stress tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 40, 46, 48, 51, 53, 55, 57, 59, 61, 65, 67, 70, 72, 75, 77, 79, and 82.

A salinity tolerance and/or oxidative stress tolerance-modulating nucleic acid can comprise the nucleotide sequence set forth in SEQ ID NO: 108. Alternatively, a salinity tolerance and/or oxidative stress tolerance-modulating nucleic acid can be a variant of the nucleic acid having the nucleotide sequence set forth in SEQ ID NO: 108. For example, a salinity tolerance and/or oxidative stress tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 108, 111, 113, 115, 117, 120, 124, 131, and 133.

A salinity tolerance and/or oxidative stress tolerance-modulating nucleic acid can comprise the nucleotide sequence set forth in SEQ ID NO: 139. Alternatively, a salinity tolerance and/or oxidative stress tolerance-modulating nucleic acid can be a variant of the nucleic acid having the nucleotide sequence set forth in SEQ ID NO: 139. For example, a salinity tolerance and/or oxidative stress tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 135, 137, 139, 146, 148, 150, 152, 155, 157, 159, 161, and 164.

A salinity tolerance and/or oxidative stress tolerance-modulating nucleic acid can comprise the nucleotide sequence set forth in SEQ ID NO: 1. Alternatively, a salinity tolerance and/or oxidative stress tolerance-modulating nucleic acid can be a variant of the nucleic acid having the nucleotide sequence set forth in SEQ ID NO: 1. For example, a salinity tolerance and/or oxidative stress tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 1, 3, 5, 7, 10, 12, 16, 18, 21, 26, 28, and 32.

A salinity tolerance and/or oxidative stress tolerance-modulating nucleic acid can comprise the nucleotide sequence set forth in SEQ ID NO: 34. Alternatively, a salinity tolerance and/or oxidative stress tolerance-modulating nucleic acid can be a variant of the nucleic acid having the nucleotide sequence set forth in SEQ ID NO: 34. For example, a salinity tolerance and/or oxidative stress tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:34.

Isolated nucleic acid molecules can be produced by standard techniques. For example, polymerase chain reaction (PCR) techniques can be used to obtain an isolated nucleic acid containing a nucleotide sequence described herein. PCR can be used to amplify specific sequences from DNA as well as RNA, including sequences from total genomic DNA or total cellular RNA. Various PCR methods are described, for example, in *PCR Primer: A Laboratory Manual*, Dieffenbach and Dveksler, eds., Cold Spring Harbor Laboratory Press, 1995. Generally, sequence information from the ends of the region of interest or beyond is employed to design oligonucleotide primers that are identical or similar in sequence to opposite strands of the template to be amplified. Various PCR strategies also are available by which site-specific nucleotide sequence modifications can be introduced into a template nucleic acid. Isolated nucleic acids also can be chemically synthesized, either as a single nucleic acid molecule (e.g., using automated DNA synthesis in the 3' to 5' direction using phosphoramidite technology) or as a series of oligonucleotides. For example, one or more pairs of long oligonucleotides (e.g., >100 nucleotides) can be synthesized that contain the desired sequence, with each pair containing a short segment of complementarity (e.g., about 15 nucleotides) such that a duplex is formed when the oligonucleotide pair is annealed. DNA polymerase is used to extend the oligonucleotides, resulting in a single, double-stranded nucleic acid molecule per oligonucleotide pair, which then can be ligated into a vector. Isolated nucleic acids of the invention also can be obtained by mutagenesis of, e.g., a naturally occurring DNA.

B. Use of Nucleic Acids to Modulate Expression of Polypeptides i. Expression of a Salinity Tolerance and/or Oxidative Stress Tolerance-Modulating Polypeptide A nucleic acid encoding one of the salinity tolerance and/or oxidative stress tolerance-modulating polypeptides described herein can be used to express the polypeptide in a plant species of interest, typically by transforming a plant cell with a nucleic acid having the coding sequence for the polypeptide operably linked in sense orientation to one or more regulatory regions. It will be appreciated that because of the degeneracy of the genetic code, a number of nucleic acids can encode a particular salinity tolerance and/or oxidative stress tolerance-modulating polypeptide; i.e., for many amino acids, there is more than one nucleotide triplet that serves as the codon for the amino acid. Thus, codons in the coding sequence for a given salinity tolerance and/or oxidative stress tolerance-modulating polypeptide can be modified such that optimal expression in a particular plant species is obtained, using appropriate codon bias tables for that species.

In some cases, expression of a salinity tolerance and/or oxidative stress tolerance-modulating polypeptide inhibits one or more functions of an endogenous polypeptide. For example, a nucleic acid that encodes a dominant negative polypeptide can be used to inhibit protein function. A dominant negative polypeptide typically is mutated or truncated relative to an endogenous wild type polypeptide, and its presence in a cell inhibits one or more functions of the wild type polypeptide in that cell, i.e., the dominant negative polypeptide is genetically dominant and confers a loss of function. The mechanism by which a dominant negative polypeptide confers such a phenotype can vary but often involves a protein-protein interaction or a protein-DNA interaction. For example, a dominant negative polypeptide can be an enzyme that is truncated relative to a native wild type enzyme, such that the truncated polypeptide retains domains involved in binding a first protein but lacks domains involved in binding a second protein. The truncated polypeptide is thus unable to properly modulate the activity of the second protein. See, e.g., US 2007/0056058. As another example, a point mutation that results in a non-conservative amino acid substitution in a catalytic domain can result in a dominant negative polypeptide. See, e.g., US 2005/032221. As another example, a dominant negative polypeptide can be a transcription factor that is truncated relative to a native wild type transcription factor, such that the truncated polypeptide retains the DNA binding domain(s) but lacks the activation domain(s). Such a truncated polypeptide can inhibit the wild type transcription factor from binding DNA, thereby inhibiting transcription activation.

ii. Inhibition of Expression of a Salinity Tolerance and/or Oxidative Stress Tolerance-Modulating Polypeptide Polynucleotides and recombinant constructs described herein can be used to inhibit expression of a salinity tolerance and/or oxidative stress tolerance-modulating polypeptide in a plant species of interest. See, e.g., Matzke and Birchler, *Nature Reviews Genetics* 6:24-35 (2005); Akashi et al., *Nature Reviews Mol. Cell. Biology* 6:413-422 (2005); Mittal, *Nature Reviews Genetics* 5:355-365 (2004); Dorsett and Tuschl, *Nature Reviews Drug Discovery* 3: 318-329 (2004); and *Nature Reviews RNA interference collection*, October 2005 at nature.com/reviews/focus/mai. A number of nucleic acid based methods, including antisense RNA, ribozyme directed RNA cleavage, post-transcriptional gene silencing (PTGS), e.g., RNA interference (RNAi), and transcriptional gene silencing (TGS) are known to inhibit gene expression in plants. Antisense technology is one well-known method. In this method, a nucleic acid segment from a gene to be repressed is cloned and operably linked to a regulatory region and a transcription termination sequence so that the antisense strand of RNA is transcribed. The recombinant construct is then transformed into plants, as described herein, and the antisense strand of RNA is produced. The nucleic acid segment need not be the entire sequence of the gene to be repressed, but typically will be substantially complementary to at least a portion of the sense strand of the gene to be repressed. Generally, higher homology can be used to compensate for the use of a shorter sequence. Typically, a sequence of at least 30 nucleotides is used, e.g., at least 40, 50, 80, 100, 200, 500 nucleotides or more.

In another method, a nucleic acid can be transcribed into a ribozyme, or catalytic RNA, that affects expression of an mRNA. See, U.S. Pat. No. 6,423,885. Ribozymes can be designed to specifically pair with virtually any target RNA and cleave the phosphodiester backbone at a specific location, thereby functionally inactivating the target RNA. Heterologous nucleic acids can encode ribozymes designed to cleave particular mRNA transcripts, thus preventing expression of a polypeptide. Hammerhead ribozymes are useful for destroying particular mRNAs, although various ribozymes that cleave mRNA at site-specific recognition sequences can be used. Hammerhead ribozymes cleave mRNAs at locations dictated by flanking regions that form complementary base pairs with the target mRNA. The sole requirement is that the target RNA contains a 5'-UG-3' nucleotide sequence. The construction and production of hammerhead ribozymes is known in the art. See, for example, U.S. Pat. No. 5,254,678 and WO 02/46449 and references cited therein. Hammerhead ribozyme sequences can be embedded in a stable RNA such as a transfer RNA (tRNA) to increase cleavage efficiency in vivo. Perriman et al., *Proc. Natl. Acad. Sci. USA*, 92(13):6175-6179 (1995); de Feyter and Gaudron, Methods in Molecular Biology, Vol. 74, Chapter 43, "Expressing Ribozymes in Plants", Edited by Turner, P. C., Humana Press Inc., Totowa, N.J. RNA endoribonucleases which have been described, such as the one that occurs naturally in *Tetrahymena thermophila*, can be useful. See, for example, U.S. Pat. Nos. 4,987,071 and 6,423,885.

PTGS, e.g., RNAi, can also be used to inhibit the expression of a gene. For example, a construct can be prepared that includes a sequence that is transcribed into an RNA that can anneal to itself, e.g., a double stranded RNA having a stem-loop structure. In some embodiments, one strand of the stem portion of a double stranded RNA comprises a sequence that is similar or identical to the sense coding sequence of a salinity tolerance and/or oxidative stress tolerance-modulating polypeptide, and that is from about 10 nucleotides to about 2,500 nucleotides in length. The length of the sequence that is similar or identical to the sense coding sequence can be from 10 nucleotides to 500 nucleotides, from 15 nucleotides to 300 nucleotides, from 20 nucleotides to 100 nucleotides, or from 25 nucleotides to 100 nucleotides. The other strand of the stem portion of a double stranded RNA comprises a sequence that is similar or identical to the antisense strand of the coding sequence of the salinity tolerance and/or oxidative stress tolerance-modulating polypeptide, and can have a length that is shorter, the same as, or longer than the corresponding length of the sense sequence. In some cases, one strand of the stem portion of a double stranded RNA comprises a sequence that is similar or identical to the 3' or 5' untranslated region of an mRNA encoding a salinity tolerance and/or oxidative stress tolerance-modulating polypeptide, and the other strand of the stem portion of the double stranded RNA comprises a sequence that is similar or identical to the sequence that is complementary to the 3' or 5' untranslated region, respectively, of the mRNA encoding the salinity tolerance and/or oxidative stress tolerance-modulating polypeptide. In other embodiments, one strand of the stem portion of a double stranded RNA comprises a sequence that is similar or identical to the sequence of an intron in the pre-mRNA encoding a salinity tolerance and/or oxidative stress tolerance-modulating polypeptide, and the other strand of the stem portion comprises a sequence that is similar or identical to the sequence that is complementary to the sequence of the intron in the pre-mRNA. The loop portion of a double stranded RNA can be from 3 nucleotides to 5,000 nucleotides, e.g., from 3 nucleotides to 25 nucleotides, from 15 nucleotides to 1,000 nucleotides, from 20 nucleotides to 500 nucleotides, or from 25 nucleotides to 200 nucleotides. The loop portion of the RNA can include an intron. A double stranded RNA can have zero, one, two, three, four, five, six, seven, eight, nine, ten, or more stem-loop structures. A construct including a sequence that is operably linked to a regulatory region and a transcription termination sequence, and that is transcribed into an RNA that can form a double stranded RNA, is transformed into plants as described herein. Methods for using RNAi to inhibit the expression of a gene are known to those of skill in the art. See, e.g., U.S. Pat. Nos. 5,034,323; 6,326,527; 6,452,067; 6,573,099; 6,753,139; and 6,777,588. See also WO 97/01952; WO 98/53083; WO 99/32619; WO 98/36083; and U.S. Patent Publications 20030175965, 20030175783, 20040214330, and 20030180945.

Constructs containing regulatory regions operably linked to nucleic acid molecules in sense orientation can also be used to inhibit the expression of a gene. The transcription product can be similar or identical to the sense coding sequence of a salinity tolerance and/or oxidative stress tolerance-modulating polypeptide. The transcription product can also be unpolyadenylated, lack a 5' cap structure, or contain an unsplicable intron. Methods of inhibiting gene expression using a full-length cDNA as well as a partial cDNA sequence are known in the art. See, e.g., U.S. Pat. No. 5,231,020.

In some embodiments, a construct containing a nucleic acid having at least one strand that is a template for both sense and antisense sequences that are complementary to each other is used to inhibit the expression of a gene. The sense and antisense sequences can be part of a larger nucleic acid molecule or can be part of separate nucleic acid molecules having sequences that are not complementary. The sense or antisense sequence can be a sequence that is identical or complementary to the sequence of an mRNA, the 3' or 5' untranslated region of an mRNA, or an intron in a pre-mRNA encoding a salinity tolerance and/or oxidative stress tolerance-modulating polypeptide. In some embodiments, the sense or antisense sequence is identical or complementary to a sequence of the regulatory region that drives transcription of the gene encoding a salinity tolerance and/or oxidative stress tolerance-modulating polypeptide. In each case, the sense sequence is the sequence that is complementary to the antisense sequence.

The sense and antisense sequences can be any length greater than about 12 nucleotides (e.g., 13, 14, 15, 16, 17, 18, 19, 20, 21, 22, 23, 24, 25, 26, 27, 28, 29, 30, or more nucleotides). For example, an antisense sequence can be 21 or 22 nucleotides in length. Typically, the sense and antisense sequences range in length from about 15 nucleotides to about 30 nucleotides, e.g., from about 18 nucleotides to about 28 nucleotides, or from about 21 nucleotides to about 25 nucleotides.

In some embodiments, an antisense sequence is a sequence complementary to an mRNA sequence encoding a salinity tolerance and/or oxidative stress tolerance-modulating polypeptide described herein. The sense sequence complementary to the antisense sequence can be a sequence present within the mRNA of the salinity tolerance and/or oxidative stress tolerance-modulating polypeptide. Typically, sense and antisense sequences are designed to correspond to a 15-30 nucleotide sequence of a target mRNA such that the level of that target mRNA is reduced.

In some embodiments, a construct containing a nucleic acid having at least one strand that is a template for more than one sense sequence (e.g., 2, 3, 4, 5, 6, 7, 8, 9, 10 or more sense sequences) can be used to inhibit the expression of a gene. Likewise, a construct containing a nucleic acid having at least one strand that is a template for more than one antisense sequence (e.g., 2, 3, 4, 5, 6, 7, 8, 9, 10 or more antisense sequences) can be used to inhibit the expression of a gene. For example, a construct can contain a nucleic acid having at least one strand that is a template for two sense sequences and two antisense sequences. The multiple sense sequences can be identical or different, and the multiple antisense sequences can be identical or different. For example, a construct can have a nucleic acid having one strand that is a template for two identical sense sequences and two identical antisense sequences that are complementary to the two identical sense sequences. Alternatively, an isolated nucleic acid can have one strand that is a template for (1) two identical sense sequences 20 nucleotides in length, (2) one antisense sequence that is complementary to the two identical sense sequences 20 nucleotides in length, (3) a sense sequence 30 nucleotides in length, and (4) three identical antisense sequences that are complementary to the sense sequence 30 nucleotides in length. The constructs provided herein can be designed to have any arrangement of sense and antisense sequences. For example, two identical sense sequences can be followed by two identical antisense sequences or can be positioned between two identical antisense sequences.

A nucleic acid having at least one strand that is a template for one or more sense and/or antisense sequences can be operably linked to a regulatory region to drive transcription of an RNA molecule containing the sense and/or antisense sequence(s). In addition, such a nucleic acid can be operably linked to a transcription terminator sequence, such as the terminator of the nopaline synthase (nos) gene. In some cases, two regulatory regions can direct transcription of two transcripts: one from the top strand, and one from the bottom strand. See, for example, Yan et al., *Plant Physiol.,* 141: 1508-1518 (2006). The two regulatory regions can be the same or different. The two transcripts can form double-stranded RNA molecules that induce degradation of the target RNA. In some cases, a nucleic acid can be positioned within a T-DNA or plant-derived transfer DNA (P-DNA) such that the left and right T-DNA border sequences, or the left and right border-like sequences of the P-DNA, flank or are on either side of the nucleic acid. See, US 2006/0265788. The nucleic acid sequence between the two regulatory regions can be from about 15 to about 300 nucleotides in length. In some embodiments, the nucleic acid sequence between the two regulatory regions is from about 15 to about 200 nucleotides in length, from about 15 to about 100 nucleotides in length, from about 15 to about 50 nucleotides in length, from about 18 to about 50 nucleotides in length, from about 18 to about 40 nucleotides in length, from about 18 to about 30 nucleotides in length, or from about 18 to about 25 nucleotides in length.

In some nucleic-acid based methods for inhibition of gene expression in plants, a suitable nucleic acid can be a nucleic acid analog. Nucleic acid analogs can be modified at the base moiety, sugar moiety, or phosphate backbone to improve, for example, stability, hybridization, or solubility of the nucleic acid. Modifications at the base moiety include deoxyuridine for deoxythymidine, and 5-methyl-2'-deoxycytidine and 5-bromo-2'-deoxycytidine for deoxycytidine. Modifications of the sugar moiety include modification of the 2' hydroxyl of the ribose sugar to form 2'-O-methyl or 2'-O-allyl sugars. The deoxyribose phosphate backbone can be modified to produce morpholino nucleic acids, in which each base moiety is linked to a six-membered morpholino ring, or peptide nucleic acids, in which the deoxyphosphate backbone is replaced by a pseudopeptide backbone and the four bases are retained. See, for example, Summerton and Weller, 1997, *Antisense Nucleic Acid Drug Dev.,* 7:187-195; Hyrup et al., *Bioorgan. Med. Chem.,* 4:5-23 (1996). In addition, the deoxyphosphate backbone can be replaced with, for example, a phosphorothioate or phosphorodithioate backbone, a phosphoroamidite, or an alkyl phosphotries ter backbone.

C. Constructs/Vectors

Recombinant constructs provided herein can be used to transform plants or plant cells in order to modulate salinity tolerance and/or oxidative stress tolerance levels. A recombinant nucleic acid construct can comprise a nucleic acid encoding a salinity tolerance and/or oxidative stress tolerance-modulating polypeptide as described herein, operably linked to a regulatory region suitable for expressing the salinity tolerance and/or oxidative stress tolerance-modulating polypeptide in the plant or cell. Thus, a nucleic acid can comprise a coding sequence that encodes any of the salinity tolerance and/or oxidative stress tolerance-modulating polypeptides as set forth in SEQ ID NOs: 1, 3, 5, 7, 10, 12, 16, 18, 21, 26, 28, 32, 34, 40, 46, 48, 51, 53, 55, 57, 59, 61, 65, 67, 70, 72, 75, 77, 79, 82, 85, 87, 89, 92, 95, 97, 99, 103, 105, 108, 111, 113, 115, 117, 120, 124, 131, 133, 135, 137, 139, 146, 148, 150, 152, 155, 157, 159, 161, and 164. Examples of nucleic acids encoding salinity tolerance and/or oxidative stress tolerance-modulating polypeptides are set forth in SEQ ID NOs: 2, 4, 6, 8, 9, 11, 13, 14, 15, 17, 19, 20, 22, 23, 24, 25, 27, 29, 30, 31, 33, 35, 36, 37, 38, 39, 41, 42, 43, 44, 45, 47, 49, 50, 52, 54, 56, 58, 60, 62, 63, 64, 66, 68, 69, 71, 73, 74, 76, 78, 80, 81, 83, 84, 86, 88, 90, 91, 93, 94, 96, 98, 100, 101, 102, 104, 106, 107, 109, 110, 112, 114, 116, 118, 119, 121, 122, 123, 125, 126, 127, 128, 129, 130, 132, 134, 136, 138, 140, 141, 142, 143, 144, 145, 147, 149, 151, 153, 154, 156, 158, 160, 162, 163, 165, 166, 167, 168, and amino acid coordinates 1 to 135 of SEQ ID NO: 138. The salinity tolerance and/or oxidative stress tolerance-modulating polypeptide encoded by a recombinant nucleic acid can be a native salinity tolerance and/or oxidative stress tolerance-modulating polypeptide, or can be heterologous to the cell. In some cases, the recombinant construct contains a nucleic acid that inhibits expression of a salinity tolerance and/or oxidative stress tolerance-modulating polypeptide, operably linked to a regulatory region. Examples of suitable regulatory regions are described in the section entitled "Regulatory Regions."

Vectors containing recombinant nucleic acid constructs such as those described herein also are provided. Suitable vector backbones include, for example, those routinely used in the art such as plasmids, viruses, artificial chromosomes, BACs, YACs, or PACs. Suitable expression vectors include, without limitation, plasmids and viral vectors derived from, for example, bacteriophage, baculoviruses, and retroviruses. Numerous vectors and expression systems are commercially available from such corporations as Novagen (Madison, Wis.), Clontech (Palo Alto, Calif.), Stratagene (La Jolla, Calif.), and Invitrogen/Life Technologies (Carlsbad, Calif.).

The vectors provided herein also can include, for example, origins of replication, scaffold attachment regions (SARs), and/or markers. A marker gene can confer a selectable phenotype on a plant cell. For example, a marker can confer biocide resistance, such as resistance to an antibiotic (e.g., kanamycin, G418, bleomycin, or hygromycin), or an herbicide (e.g., glyphosate, chlorsulfuron or phosphinothricin). In addition, an expression vector can include a tag sequence designed to facilitate manipulation or detection (e.g., purification or localization) of the expressed polypeptide. Tag sequences, such as luciferase, β-glucuronidase (GUS), green fluorescent protein (GFP), glutathione S-transferase (GST), polyhistidine, c-myc, hemagglutinin, or Flag™ tag (Kodak, New Haven, Conn.) sequences typically are expressed as a fusion with the encoded polypeptide. Such tags can be inserted anywhere within the polypeptide, including at either the carboxyl or amino terminus.

D. Regulatory Regions

The choice of regulatory regions to be included in a recombinant construct depends upon several factors, including, but not limited to, efficiency, selectability, inducibility, desired expression level, and cell- or tissue-preferential expression. It is a routine matter for one of skill in the art to modulate the expression of a coding sequence by appropriately selecting and positioning regulatory regions relative to the coding sequence. Transcription of a nucleic acid can be modulated in a similar manner.

Some suitable promoters initiate transcription only, or predominantly, in certain cell types. The choice of regulatory regions to be included in a recombinant construct depends upon several factors, including, but not limited to, efficiency, selectability, inducibility, desired expression level, and cell- or tissue-preferential expression. It is a routine matter for one of skill in the art to modulate the expression of a coding sequence by appropriately selecting and positioning regulatory regions relative to the coding sequence. Transcription of a nucleic acid can be modulated in a similar manner.

Some suitable regulatory regions initiate transcription only, or predominantly, in certain cell types. Methods for identifying and characterizing regulatory regions in plant genomic DNA are known, including, for example, those described in the following references: Jordano et al., *Plant Cell*, 1:855-866 (1989); Bustos et al., *Plant Cell*, 1:839-854 (1989); Green et al., *EMBO J.*, 7:4035-4044 (1989); Meier et al., *Plant Cell*, 3:309-316 (1991); and Zhang et al., *Plant Physiology*, 110:1069-1079 (1996).

Examples of various classes of regulatory regions are described below. Some of the regulatory regions indicated below as well as additional regulatory regions are described in more detail in U.S. patent application Ser. Nos. 60/505,689; 60/518,075; 60/544,771; 60/558,869; 60/583,691; 60/619,181; 60/637,140; 60/757,544; 60/776,307; 10/957,569; 11/058,689; 11/172,703; 11/208,308; 11/274,890; 60/583,609; 60/612,891; 11/097,589; 11/233,726; 11/408,791; 11/414,142; 10/950,321; 11/360,017; PCT/US05/011105; PCT/US05/23639; PCT/US05/034308; PCT/US05/034343; and PCT/US06/038236; PCT/US06/040572; and PCT/US07/62762.

For example, the sequences of regulatory regions p326, YP0144, YP0190, p13879, YP0050, p32449, 21876, YP0158, YP0214, YP0380, PT0848, PT0633, YP0128, YP0275, PT0660, PT0683, PT0758, PT0613, PT0672, PT0688, PT0837, YP0092, PT0676, PT0708, YP0396, YP0007, YP0111, YP0103, YP0028, YP0121, YP0008, YP0039, YP0115, YP0119, YP0120, YP0374, YP0101, YP0102, YP0110, YP0117, YP0137, YP0285, YP0212, YP0097, YP0107, YP0088, YP0143, YP0156, PT0650, PT0695, PT0723, PT0838, PT0879, PT0740, PT0535, PT0668, PT0886, PT0585, YP0381, YP0337, PT0710, YP0356, YP0385, YP0384, YP0286, YP0377, PD1367, PT0863, PT0829, PT0665, PT0678, YP0086, YP0188, YP0263, PT0743 and YP0096 are set forth in the sequence listing of PCT/US06/040572; the sequence of regulatory region PT0625 is set forth in the sequence listing of PCT/US05/034343; the sequences of regulatory regions PT0623, YP0388, YP0087, YP0093, YP0108, YP0022 and YP0080 are set forth in the sequence listing of U.S. patent application Ser. No. 11/172,703; the sequence of regulatory region PRO924 is set forth in the sequence listing of PCT/US07/62762; and the sequences of regulatory regions p530c10, pOsFIE2-2, pOsMEA, pOsYp102, and pOsYp285 are set forth in the sequence listing of PCT/US06/038236.

It will be appreciated that a regulatory region may meet criteria for one classification based on its activity in one plant species, and yet meet criteria for a different classification based on its activity in another plant species.

i. Broadly Expressing Promoters

A promoter can be said to be "broadly expressing" when it promotes transcription in many, but not necessarily all, plant tissues. For example, a broadly expressing promoter can promote transcription of an operably linked sequence in one or more of the shoot, shoot tip (apex), and leaves, but weakly or not at all in tissues such as roots or stems. As another example, a broadly expressing promoter can promote transcription of an operably linked sequence in one or more of the stem, shoot, shoot tip (apex), and leaves, but can promote transcription weakly or not at all in tissues such as reproductive tissues of flowers and developing seeds. Non-limiting examples of broadly expressing promoters that can be included in the nucleic acid constructs provided herein include the p326, YP0144, YP0190, p13879, YP0050, p32449, 21876, YP0158, YP0214, YP0380, PT0848, and PT0633 promoters. Additional examples include the cauliflower mosaic virus (CaMV) 35S promoter, the mannopine synthase (MAS) promoter, the 1' or 2' promoters derived from T-DNA of *Agrobacterium tumefaciens*, the figwort mosaic virus 34S promoter, actin promoters such as the rice actin promoter, and ubiquitin promoters such as the maize ubiquitin-1 promoter. In some cases, the CaMV 35S promoter is excluded from the category of broadly expressing promoters.

ii. Root Promoters

Root-active promoters confer transcription in root tissue, e.g., root endodermis, root epidermis, or root vascular tissues. In some embodiments, root-active promoters are root-preferential promoters, i.e., confer transcription only or predominantly in root tissue. Root-preferential promoters include the YP0128, YP0275, PT0625, PT0660, PT0683, and PT0758 promoters. Other root-preferential promoters include the PT0613, PT0672, PT0688, and PT0837 promoters, which drive transcription primarily in root tissue and to a lesser extent in ovules and/or seeds. Other examples of root-preferential promoters include the root-specific subdomains of the CaMV 35S promoter (Lam et al., *Proc. Natl. Acad. Sci. USA*, 86:7890-7894 (1989)), root cell specific promoters reported by Conkling et al., *Plant Physiol.*, 93:1203-1211 (1990), and the tobacco RD2 promoter.

iii. Maturing Endosperm Promoters

In some embodiments, promoters that drive transcription in maturing endosperm can be useful. Transcription from a maturing endosperm promoter typically begins after fertilization and occurs primarily in endosperm tissue during seed development and is typically highest during the cellularization phase. Most suitable are promoters that are active predominantly in maturing endosperm, although promoters that are also active in other tissues can sometimes be used. Non-limiting examples of maturing endosperm promoters that can be included in the nucleic acid constructs provided herein include the napin promoter, the Arcelin-5 promoter, the phaseolin promoter (Bustos et al., *Plant Cell*, 1(9):839-853 (1989)), the soybean trypsin inhibitor promoter (Riggs et al., *Plant Cell*, 1(6):609-621 (1989)), the ACP promoter (Baerson et al., *Plant Mol. Biol.*, 22(2):255-267 (1993)), the stearoyl-ACP desaturase promoter (Slocombe et al., *Plant Physiol.*, 104(4):167-176 (1994)), the soybean α' subunit of β-conglycinin promoter (Chen et al., *Proc. Natl. Acad. Sci. USA*, 83:8560-8564 (1986)), the oleosin promoter (Hong et al., *Plant Mol. Biol.*, 34(3):549-555 (1997)), and zein promoters, such as the 15 kD zein promoter, the 16 kD zein promoter, 19 kD zein promoter, 22 kD zein promoter and 27 kD zein promoter. Also suitable are the Osgt-1 promoter from the rice glutelin-1 gene (Zheng et al., *Mol. Cell. Biol.*, 13:5829-5842 (1993)), the beta-amylase promoter, and the barley hordein promoter. Other maturing endosperm promoters include the YP0092, PT0676, and PT0708 promoters.

iv. Ovary Tissue Promoters

Promoters that are active in ovary tissues such as the ovule wall and mesocarp can also be useful, e.g., a polygalacturonidase promoter, the banana TRX promoter, the melon actin promoter, YP0396, and PT0623. Examples of promoters that are active primarily in ovules include YP0007, YP0111, YP0092, YP0103, YP0028, YP0121, YP0008, YP0039, YP0115, YP0119, YP0120, and YP0374.

v. Embryo Sac/Early Endosperm Promoters

To achieve expression in embryo sac/early endosperm, regulatory regions can be used that are active in polar nuclei and/or the central cell, or in precursors to polar nuclei, but not in egg cells or precursors to egg cells. Most suitable are promoters that drive expression only or predominantly in polar nuclei or precursors thereto and/or the central cell. A pattern of transcription that extends from polar nuclei into early endosperm development can also be found with embryo sac/early endosperm-preferential promoters, although transcription typically decreases significantly in later endosperm development during and after the cellularization phase. Expression in the zygote or developing embryo typically is not present with embryo sac/early endosperm promoters.

Promoters that may be suitable include those derived from the following genes: *Arabidopsis* viviparous-1 (see, GenBank No. U93215); *Arabidopsis* atmyc1 (see, Urao (1996) *Plant Mol. Biol.*, 32:571-57; Conceicao (1994) *Plant*, 5:493-505); *Arabidopsis* FIE (GenBank No. AF129516); *Arabidopsis* MEA; *Arabidopsis* FIS2 (GenBank No. AF096096); and FIE 1.1 (U.S. Pat. No. 6,906,244). Other promoters that may be suitable include those derived from the following genes: maize MAC1 (see, Sheridan (1996) *Genetics*, 142: 1009-1020); maize Cat3 (see, GenBank No. L05934; Abler (1993) *Plant Mol. Biol.*, 22:10131-1038). Other promoters include the following *Arabidopsis* promoters: YP0039, YP0101, YP0102, YP0110, YP0117, YP0119, YP0137, DME, YP0285, and YP0212. Other promoters that may be useful include the following rice promoters: p530c10, pOsFIE2-2, pOsMEA, pOsYp102, and pOsYp285.

vi. Embryo Promoters

Regulatory regions that preferentially drive transcription in zygotic cells following fertilization can provide embryo-preferential expression. Most suitable are promoters that preferentially drive transcription in early stage embryos prior to the heart stage, but expression in late stage and maturing embryos is also suitable. Embryo-preferential promoters include the barley lipid transfer protein (Ltp1) promoter (*Plant Cell Rep* (2001) 20:647-654), YP0097, YP0107, YP0088, YP0143, YP0156, PT0650, PT0695, PT0723, PT0838, PT0879, and PT0740.

vii. Photosynthetic Tissue Promoters

Promoters active in photosynthetic tissue confer transcription in green tissues such as leaves and stems. Most suitable are promoters that drive expression only or predominantly in such tissues. Examples of such promoters include the ribulose-1,5-bisphosphate carboxylase (RbcS) promoters such as the RbcS promoter from eastern larch (*Larix laricina*), the pine cab6 promoter (Yamamoto et al., *Plant Cell Physiol.*, 35:773-778 (1994)), the Cab-1 promoter from wheat (Fejes et al., *Plant Mol. Biol.*, 15:921-932 (1990)), the CAB-1 promoter from spinach (Lubberstedt et al., *Plant Physiol.*, 104:997-1006 (1994)), the cab1R promoter from rice (Luan et al., *Plant Cell*, 4:971-981 (1992)), the pyruvate orthophosphate dikinase (PPDK) promoter from corn (Matsuoka et al., *Proc. Natl. Acad. Sci. USA*, 90:9586-9590 (1993)), the tobacco Lhcb1*2 promoter (Cerdan et al., *Plant Mol. Biol.*, 33:245-255 (1997)), the *Arabidopsis thaliana* SUC2 sucrose-H+ symporter promoter (Truernit et al., *Planta*, 196:564-570 (1995)), and thylakoid membrane protein promoters from spinach (psaD, psaF, psaE, PC, FNR, atpC, atpD, cab, rbcS). Other photosynthetic tissue promoters include PT0535, PT0668, PT0886, YP0144, YP0380 and PT0585.

viii. Vascular Tissue Promoters

Examples of promoters that have high or preferential activity in vascular bundles include YP0087, YP0093, YP0108, YP0022, and YP0080. Other vascular tissue-preferential promoters include the glycine-rich cell wall protein GRP 1.8 promoter (Keller and Baumgartner, *Plant Cell*, 3(10):1051-1061 (1991)), the Commelina yellow mottle virus (CoYMV) promoter (Medberry et al., *Plant Cell*, 4(2):185-192 (1992)), and the rice tungro baciliform virus (RTBV) promoter (Dai et al., *Proc. Natl. Acad. Sci. USA*, 101(2):687-692 (2004)).

ix. Inducible Promoters

Inducible promoters confer transcription in response to external stimuli such as chemical agents or environmental stimuli. For example, inducible promoters can confer transcription in response to hormones such as giberellic acid or ethylene, or in response to light or drought. Examples of drought-inducible promoters include YP0380, PT0848, YP0381, YP0337, PT0633, YP0374, PT0710, YP0356, YP0385, YP0396, YP0388, YP0384, PT0688, YP0286, YP0377, PD1367, and PD0901. Examples of nitrogen-inducible promoters include PT0863, PT0829, PT0665, and PT0886. Examples of shade-inducible promoters include PRO924 and PT0678. An example of a promoter induced by salt is rd29A (Kasuga et al. (1999) *Nature Biotech* 17: 287-291).

x. Basal Promoters

A basal promoter is the minimal sequence necessary for assembly of a transcription complex required for transcription initiation. Basal promoters frequently include a "TATA box" element that may be located between about 15 and about 35 nucleotides upstream from the site of transcription initiation. Basal promoters also may include a "CCAAT box" element (typically the sequence CCAAT) and/or a GGGCG sequence, which can be located between about 40 and about 200 nucleotides, typically about 60 to about 120 nucleotides, upstream from the transcription start site.

xi. Other Promoters

Other classes of promoters include, but are not limited to, shoot-preferential, callus-preferential, trichome cell-preferential, guard cell-preferential such as PT0678, tuber-preferential, parenchyma cell-preferential, and senescence-preferential promoters. Promoters designated YP0086, YP0188, YP0263, PT0758, PT0743, PT0829, YP0119, and YP0096, as described in the above-referenced patent applications, may also be useful.

xii. Other Regulatory Regions

A 5' untranslated region (UTR) can be included in nucleic acid constructs described herein. A 5' UTR is transcribed, but is not translated, and lies between the start site of the transcript and the translation initiation codon and may include the +1 nucleotide. A 3' UTR can be positioned between the translation termination codon and the end of the transcript. UTRs can have particular functions such as increasing mRNA stability or attenuating translation. Examples of 3' UTRs include, but are not limited to, polyadenylation signals and transcription termination sequences, e.g., a nopaline synthase termination sequence.

It will be understood that more than one regulatory region may be present in a recombinant polynucleotide, e.g., introns, enhancers, upstream activation regions, transcription terminators, and inducible elements. Thus, for example, more than one regulatory region can be operably linked to the sequence of a polynucleotide encoding a salt and/or oxidative stress tolerance modulating polypeptide.

Regulatory regions, such as promoters for endogenous genes, can be obtained by chemical synthesis or by subcloning from a genomic DNA that includes such a regulatory region. A nucleic acid comprising such a regulatory region can also include flanking sequences that contain restriction enzyme sites that facilitate subsequent manipulation.

Alternatively, misexpression can be accomplished using a two component system, whereby the first component consists of a transgenic plant comprising a transcriptional activator operatively linked to a promoter and the second component consists of a transgenic plant that comprise a nucleic acid molecule of the invention operatively linked to the target-binding sequence/region of the transcriptional activator. The two transgenic plants are crossed and the nucleic acid molecule of the invention is expressed in the progeny of the plant. In another alternative embodiment of the present invention, the misexpression can be accomplished by having the sequences of the two component system transformed in one transgenic plant line.

IV. Transgenic Plants and Plant Cells

A. Transformation

The invention also features transgenic plant cells and plants comprising at least one recombinant nucleic acid construct described herein. A plant or plant cell can be transformed by having a construct integrated into its genome, i.e., can be stably transformed. Stably transformed cells typically retain the introduced nucleic acid with each cell division. A plant or plant cell can also be transiently transformed such that the construct is not integrated into its genome. Transiently transformed cells typically lose all or some portion of the introduced nucleic acid construct with each cell division such that the introduced nucleic acid cannot be detected in daughter cells after a sufficient number of cell divisions. Both transiently transformed and stably transformed transgenic plants and plant cells can be useful in the methods described herein.

Transgenic plant cells used in methods described herein can constitute part or all of a whole plant. Such plants can be grown in a manner suitable for the species under consideration, either in a growth chamber, a greenhouse, or in a field. Transgenic plants can be bred as desired for a particular purpose, e.g., to introduce a recombinant nucleic acid into other lines, to transfer a recombinant nucleic acid to other species, or for further selection of other desirable traits. Alternatively, transgenic plants can be propagated vegetatively for those species amenable to such techniques. As used herein, a transgenic plant also refers to progeny of an initial transgenic plant having the transgene. Seeds produced by a transgenic plant can be grown and then selfed (or outcrossed and selfed) to obtain seeds homozygous for the nucleic acid construct.

Transgenic plants can be grown in suspension culture, or tissue or organ culture. For the purposes of this invention, solid and/or liquid tissue culture techniques can be used. When using solid medium, transgenic plant cells can be placed directly onto the medium or can be placed onto a filter that is then placed in contact with the medium. When using liquid medium, transgenic plant cells can be placed onto a flotation device, e.g., a porous membrane that contacts the liquid medium. A solid medium can be, for example, Murashige and Skoog (MS) medium containing agar and a suitable concentration of an auxin, e.g., 2,4-dichlorophenoxyacetic acid (2,4-D), and a suitable concentration of a cytokinin, e.g., kinetin.

When transiently transformed plant cells are used, a reporter sequence encoding a reporter polypeptide having a reporter activity can be included in the transformation procedure and an assay for reporter activity or expression can be performed at a suitable time after transformation. A suitable time for conducting the assay typically is about 1-21 days after transformation, e.g., about 1-14 days, about 1-7 days, or about 1-3 days. The use of transient assays is particularly convenient for rapid analysis in different species, or to confirm expression of a heterologous salinity tolerance and/or oxidative stress tolerance-modulating polypeptide whose expression has not previously been confirmed in particular recipient cells.

Techniques for introducing nucleic acids into monocotyledonous and dicotyledonous plants are known in the art, and include, without limitation, Agrobacterium-mediated transformation, viral vector-mediated transformation, electroporation and particle gun transformation, e.g., U.S. Pat. Nos. 5,538,880; 5,204,253; 6,329,571 and 6,013,863. If a cell or cultured tissue is used as the recipient tissue for transformation, plants can be regenerated from transformed cultures if desired, by techniques known to those skilled in the art.

B. Screening/selection

A population of transgenic plants can be screened and/or selected for those members of the population that have a trait or phenotype conferred by expression of the transgene. For example, a population of progeny of a single transformation event can be screened for those plants having a desired level of expression of a salinity tolerance and/or oxidative stress tolerance-modulating polypeptide or nucleic acid. Physical and biochemical methods can be used to identify expression levels. These include Southern analysis or PCR amplification for detection of a polynucleotide; Northern blots, S1 RNase protection, primer-extension, or RT-PCR amplification for detecting RNA transcripts; enzymatic assays for detecting enzyme or ribozyme activity of polypeptides and polynucleotides; and protein gel electrophoresis, Western blots, immunoprecipitation, and enzyme-linked immunoassays to detect polypeptides. Other techniques such as in situ hybridization, enzyme staining, and immunostaining also can be used to detect the presence or expression of polypeptides and/or polynucleotides. Methods for performing all of the referenced techniques are known. As an alternative, a population of plants comprising independent transformation events can be screened for those plants having a desired trait, such as a modulated level of salinity tolerance and/or oxidative stress tolerance. Selection and/or screening can be carried out over one or more generations, and/or in more than one geographic location. In some cases, transgenic plants can be grown and selected under conditions which induce a desired phenotype or are otherwise necessary to produce a desired phenotype in a transgenic plant. In addition, selection and/or screening can be applied during a particular developmental stage in which the phenotype is expected to be exhibited by the plant. Selection and/or screening can be carried out to choose those transgenic plants having a statistically significant difference in a salinity tolerance and/or oxidative stress tolerance level relative to a control plant that lacks the transgene. Selected or screened transgenic plants have an altered phenotype as compared to a corresponding control plant, as described in the "Transgenic Plant Phenotypes" section herein.

A population of transgenic plants can be screened and/or selected for those members of the population that have a trait or phenotype conferred by expression of the transgene. For example, a population of progeny of a single transformation event can be screened for those plants having a desired level of expression of a saline and/or oxidative stress tolerance-modulating polypeptide and/or nucleic acid. Physical and biochemical methods can be used to identify expression levels. These include Southern analysis or PCR amplification for detection of a polynucleotide; Northern blots, S1 RNase protection, primer-extension, or RT-PCR amplification for detecting RNA transcripts; enzymatic assays for detecting enzyme or ribozyme activity of polypeptides and polynucleotides; and protein gel electrophoresis, Western blots, immunoprecipitation, and enzyme-linked immunoassays to detect polypeptides. Other techniques such as in situ hybridization, enzyme staining, and immunostaining also can be used to detect the presence or expression of polypeptides and/or polynucleotides. Methods for performing all of the referenced techniques are known. As an alternative, a population of plants comprising independent transformation events can be screened for those plants having a desired trait, such as a modulated level of saline and/or oxidative stress tolerance. Selection and/or screening can be carried out over one or more generations, and/or in more than one geographic location. In some cases, transgenic plants can be grown and selected under conditions which induce a desired phenotype or are otherwise necessary to produce a desired phenotype in a transgenic plant. In addition, selection and/or screening can be applied during a particular developmental stage in which the phenotype is expected to be exhibited by the plant. Selection and/or screening can be carried out to choose those transgenic plants having a statistically significant difference in a saline and/or oxidative stress tolerance level relative to a control plant that lacks the transgene. Selected or screened transgenic plants have an altered phenotype as compared to a corresponding control plant, as described in the "Transgenic Plant Phenotypes" section herein.

C. Plant Species

The polynucleotides and vectors described herein can be used to transform a number of monocotyledonous and dicotyledonous plants and plant cell systems, including species from one of the following families. *Acanthaceae, Alliaceae, Alstroemeriaceae, Amaryllidaceae, Apocynaceae, Arecaceae, Asteraceae, Berberidaceae, Bixaceae, Brassicaceae, Bromeliaceae, Cannabaceae, Caryophyllaceae, Cephalotaxaceae, Chenopodiaceae, Colchicaceae, Cucurbitaceae, Dioscoreaceae, Ephedraceae, Erythroxylaceae, Euphorbiaceae, Fabaceae, Lamiaceae, Linaceae, Lycopodiaceae, Malvaceae, Melanthiaceae, Musaceae, Myrtaceae, Nyssaceae, Papaveraceae, Pinaceae, Plantaginaceae, Poaceae, Rosaceae, Rubiaceae, Salicaceae, Sapindaceae, Solanaceae, Taxaceae, Theaceae,* or *Vitaceae*.

Suitable species may include members of the genus *Abelmoschus, Abies, Acer, Agrostis, Allium, Alstroemeria, Ananas, Andrographis, Andropogon, Artemisia, Arundo, Atropa, Berberis, Beta, Bixa, Brassica, Calendula, Camellia, Camptotheca, Cannabis, Capsicum, Carthamus, Catharanthus, Cephalotaxus, Chrysanthemum, Cinchona, Citrullus, Coffea, Colchicum, Coleus, Cucumis, Cucurbita, Cynodon, Datura, Dianthus, Digitalis, Dioscorea, Elaeis, Ephedra, Erianthus, Erythroxylum, Eucalyptus, Festuca, Fragaria, Galanthus, Glycine, Gossypium, Helianthus, Hevea, Hordeum, Hyoscyamus, Jatropha, Lactuca, Linum, Lolium, Lupinus, Lycopersicon, Lycopodium, Manihot, Medicago, Mentha, Miscanthus, Musa, Nicotiana, Oryza, Panicum, Papaver, Parthenium, Pennisetum, Petunia, Phalaris, Phleum, Pinus, Poa, Poinsettia, Populus, Rauwolfia, Ricinus, Rosa, Saccharum, Salix, Sanguinaria, Scopolia, Secale, Solanum, Sorghum, Spartina, Spinacea, Tanacetum, Taxus, Theobroma, Triticosecale, Triticum, Uniola, Veratrum, Vinca, Vitis,* and *Zea*.

Suitable species include *Panicum* spp., *Sorghum* spp., *Miscanthus* spp., *Saccharum* spp., *Erianthus* spp., *Populus* spp., *Andropogon gerardii* (big bluestem), *Pennisetum purpureum* (elephant grass), *Phalaris arundinacea* (reed canarygrass), *Cynodon dactylon* (bermudagrass), *Festuca arundinacea* (tall fescue), *Spartina pectinata* (prairie cordgrass), *Medicago sativa* (alfalfa), *Arundo donax* (giant reed), *Secale cereale* (rye), *Salix* spp. (willow), *Eucalyptus* spp. (eucalyptus), Triticosecale (triticum—wheat X rye) and bamboo.

Suitable species also include *Helianthus annuus* (sunflower), *Carthamus tinctorius* (safflower), *Jatropha curcas* (jatropha), *Ricinus communis* (castor), *Elaeis guineensis* (palm), *Linum usitatissimum* (flax), and *Brassica juncea*.

Suitable species also include *Beta vulgaris* (sugarbeet), and *Manihot esculenta* (cassaya).

Suitable species also include *Lycopersicon esculentum* (tomato), *Lactuca sativa* (lettuce), *Musa* paradisiaca (banana), *Solanum tuberosum* (potato), *Brassica oleracea* (broccoli, cauliflower, brusselsprouts), *Camellia sinensis* (tea), *Fragaria ananassa* (strawberry), *Theobroma cacao* (cocoa), *Coffea arabica* (coffee), *Vitis vinifera* (grape), *Ananas comosus* (pineapple), *Capsicum annum* (hot & sweet pepper), *Allium cepa* (onion), *Cucumis melo* (melon), *Cucumis sativus* (cucumber), *Cucurbita maxima* (squash), *Cucurbita moschata* (squash), *Spinacea oleracea* (spinach), *Citrullus lanatus* (watermelon), *Abelmoschus esculentus* (okra), and *Solanum melongena* (eggplant).

Suitable species also include *Papaver somniferum* (opium poppy), *Papaver orientale, Taxus baccata, Taxus brevifolia, Artemisia annua, Cannabis sativa, Camptotheca acuminate, Catharanthus roseus, Vinca rosea, Cinchona officinalis, Colchicum autumnale, Veratrum californica., Digitalis lanata, Digitalis purpurea, Dioscorea* spp., *Andrographis paniculata, Atropa belladonna, Datura stomonium, Berberis* spp., *Cephalotaxus* spp., *Ephedra sinica, Ephedra* spp., *Erythroxylum coca, Galanthus wornorii, Scopolia* spp., *Lycopodium serratum* (=*Huperzia serrata*), *Lycopodium* spp., *Rauwolfia serpentina, Rauwolfia* spp., *Sanguinaria canadensis, Hyoscyamus* spp., *Calendula officinalis, Chrysanthemum parthenium, Coleus forskohlii,* and *Tanacetum parthenium*.

Suitable species also include *Parthenium argentatum* (guayule), *Hevea* spp. (rubber), *Mentha spicata* (mint), *Mentha piperita* (mint), *Bixa orellana,* and *Alstroemeria* spp.

Suitable species also include *Rosa* spp. (rose), *Dianthus caryophyllus* (carnation), *Petunia* spp. (petunia) and Poinsettia pulcherrima (poinsettia).

Suitable species also include *Nicotiana tabacum* (tobacco), *Lupinus albus* (lupin), *Uniola paniculata* (oats), bentgrass (*Agrostis* spp.), *Populus tremuloides* (aspen), *Pinus* spp. (pine), *Abies* spp. (fir), *Acer* spp. (maple, *Hordeum vulgare* (barley), *Poa pratensis* (bluegrass), *Lolium* spp. (ryegrass) and *Phleum pratense* (timothy).

Thus, the methods and compositions can be used over a broad range of plant species, including species from the dicot genera *Brassica, Carthamus, Glycine, Gossypium, Helianthus, Jatropha, Parthenium, Populus,* and *Ricinus*; and the monocot genera *Elaeis, Festuca, Hordeum, Lolium, Oryza, Panicum, Pennisetum, Phleum, Poa, Saccharum, Secale, Sorghum, Triticosecale, Triticum,* and *Zea*. In some embodiments, a plant is a member of the species *Panicum virgatum* (switchgrass), *Sorghum bicolor* (sorghum, sudangrass), *Miscanthus giganteus* (miscanthus), *Saccharum* sp. (energycane), *Populus balsamifera* (poplar), *Zea mays* (corn), *Glycine max* (soybean), *Brassica napus* (canola), *Triticum aestivum* (wheat), *Gossypium hirsutum* (cotton), *Oryza sativa* (rice), *Helianthus annuus* (sunflower), *Medicago sativa* (alfalfa), *Beta vulgaris* (sugarbeet), or *Pennisetum glaucum* (pearl millet).

In certain embodiments, the polynucleotides and vectors described herein can be used to transform a number of monocotyledonous and dicotyledonous plants and plant cell systems, wherein such plants are hybrids of different species or varieties of a species (e.g., *Saccharum* sp.×*Miscanthus* sp.)

D. Transgenic Plant Phenotypes

In some embodiments, a plant in which expression of a salinity and/or oxidative stress modulating polypeptide is modulated can have increased levels of tolerance to salinity and/or oxidative stress. For example, a salinity and/or oxidative stress-modulating polypeptide described herein can be expressed in a transgenic plant, resulting in increased levels of tolerance to salinity and/or oxidative stress. The salinity and/or oxidative stress tolerance levels can be increased by at least 2 percent, e.g., 2, 3, 4, 5, 6, 7, 8, 9, 10, 11, 12, 13, 14, 15, 16, 17, 18, 19, 20, 25, 30, 35, 40, 45, 50, 55, 60, or more than 60 percent, as compared to those levels in a corresponding control plant that does not express the transgene.

The nucleic acid molecules and polypeptides of the present invention are of interest because when the nucleic acid molecules are mis-expressed (i.e., when expressed at a non-natural location or in an increased or decreased amount relative to wild-type) they produce plants that exhibit improved salt tolerance and/or oxidation tolerance as compared to wild-type plants, as evidenced in part by the results of various experiments disclosed below. In particular, plants transformed with the nucleic acid molecules and polypeptides of the present invention can have any of a number of modified characteristics as compared to wild-type plants. Examples of modified characteristics include photosynthetic efficiency, seedling area, and biomass as it may be measured by plant height, leaf or rosette area, or dry mass. The modified characteristics may be observed and measured at different plant developmental stages, e.g. seed, seedling, bolting, senescense, etc. Often, salt or oxidative tolerance can be expressed as ratios or combinations of measurements, such as salt growth index values, or salicylic acid growth index values. For example, plants transformed with the sequences of the present invention can exhibit increases in SGI, seedling area and/or SAGI values of at least 5%, at least 10%, at least 25%, at least 50%, at least 75%, at least 100%, at least 200%, at least 300%, at least 400%, or even at least 500%. These traits can be used to exploit or maximize plant products. For example, the nucleic acid molecules and polypeptides of the present invention are used to increase the expression of genes that cause the plant to have improved biomass, growth rate and/or seedling vigor in saline and/or oxidative conditions, in comparison to wild type plants under the same conditions.

Because the disclosed sequences and methods increase vegetative growth and growth rate in saline and/or oxidative conditions, the disclosed methods can be used to enhance plant growth in plants grown in saline and/or oxidative conditions. For example, plants of the present invention show, under saline and/or oxidative conditions, increased photosynthetic efficiency and increased seedling area as compared to a plant of the same species that is not genetically modified for substantial vegetative growth. Examples of increases in biomass production include increases of at least 5%, at least 20%, or even at least 50%, when compared to an amount of biomass production by a wild-type plant of the same species under identical conditions.

Typically, a difference in the amount of tolerance to salinity and/or oxidative stress in a transgenic plant or cell relative to a control plant or cell is considered statistically significant at $p \leq 0.05$ with an appropriate parametric or non-parametric statistic, e.g., Chi-square test, Student's t-test, Mann-Whitney test, or F-test. In some embodiments, a difference in the amount of tolerance to salinity and/or oxidative stress is statistically significant at $p<0.01$, $p<0.005$, or $p<0.001$.

The phenotype of a transgenic plant is evaluated relative to a control plant. A plant is said "not to express" a polypeptide when the plant exhibits less than 10%, e.g., less than 9%, 8%, 7%, 6%, 5%, 4%, 3%, 2%, 1%, 0.5%, 0.1%, 0.01%, or 0.001%, of the amount of polypeptide or mRNA encoding the polypeptide exhibited by the plant of interest. Expression can be evaluated using methods including, for example, RT-PCR, Northern blots, S1 RNase protection, primer extensions, Western blots, protein gel electrophoresis, immunoprecipitation, enzyme-linked immunoassays, chip assays, and mass spectrometry. It should be noted that if a polypeptide is expressed under the control of a tissue-preferential or broadly expressing promoter, expression can be evaluated in the entire plant or in a selected tissue. Similarly, if a polypeptide is expressed at a particular time, e.g., at a particular time in development or upon induction, expression can be evaluated selectively at a desired time period.

V. Plant Breeding

Genetic polymorphisms are discrete allelic sequence differences in a population. Typically, an allele that is present at 1% or greater is considered to be a genetic polymorphism. The discovery that polypeptides disclosed herein can modulate salinity tolerance and/or oxidative stress tolerance content is useful in plant breeding, because genetic polymorphisms exhibiting a degree of linkage with loci for such polypeptides are more likely to be correlated with variation in a salinity tolerance and/or oxidative stress tolerance trait. For example, genetic polymorphisms linked to the loci for such polypeptides are more likely to be useful in marker-assisted breeding programs to create lines having a desired modulation in the salinity tolerance and/or oxidative stress tolerance traits.

Thus, one aspect of the invention includes methods of identifying whether one or more genetic polymorphisms are associated with variation in a salinity tolerance and/or oxidative stress tolerance trait. Such methods involve determining whether genetic polymorphisms in a given population exhibit linkage with the locus for one of the polypeptides depicted in FIGS. 1 thru 6 and/or a functional homolog thereof, such as, but not limited to, those in the Sequence Listing. The correlation is measured between variation in the salinity tolerance and/or oxidative stress tolerance traits in plants of the population and the presence of the genetic polymorphism(s) in plants of the population, thereby identifying whether or not the genetic polymorphism(s) are associated with variation for the traits. If the presence of a particular allele is statistically significantly correlated with a desired modulation in the salinity tolerance and/or oxidative stress tolerance traits, the allele is associated with variation for one or both of the traits and is useful as a marker for one or more of the traits. If, on the other hand, the presence of a particular allele is not significantly correlated with the desired modulation, the allele is not associated with variation for one or more of the traits and is not useful as a marker.

Such methods are applicable to populations containing the naturally occurring endogenous polypeptide rather than an exogenous nucleic acid encoding the polypeptide, i.e., populations that are not transgenic for the exogenous nucleic acid. It will be appreciated, however, that populations suitable for use in the methods may contain a transgene for another, different trait, e.g., herbicide resistance.

Genetic polymorphisms that are useful in such methods include simple sequence repeats (SSRs, or microsatellites), rapid amplification of polymorphic DNA (RAPDs), single nucleotide polymorphisms (SNPs), amplified fragment length polymorphisms (AFLPs) and restriction fragment length polymorphisms (RFLPs). SSR polymorphisms can be identified, for example, by making sequence specific probes and amplifying template DNA from individuals in the population of interest by PCR. If the probes flank an SSR in the population, PCR products of different sizes will be produced. See, e.g., U.S. Pat. No. 5,766,847. Alternatively, SSR polymorphisms can be identified by using PCR product(s) as a probe against Southern blots from different individuals in the population. See, U. H. Refseth et al., (1997) Electrophoresis 18: 1519. The identification of RFLPs is discussed, for example, in Alonso-Blanco et al. (Methods in Molecular Biology, vol. 82, *"Arabidopsis* Protocols", pp. 137-146, J. M. Martinez-Zapater and J. Salinas, eds., c. 1998 by Humana Press, Totowa, N.J.); Burr ("Mapping Genes with Recombinant Inbreds", pp. 249-254, in Freeling, M. and V. Walbot (Ed.), The Maize Handbook, c. 1994 by Springer-Verlag New York, Inc.: New York, N.Y., USA; Berlin Germany; Burr et al. Genetics (1998) 118: 519; and Gardiner, J. et al., (1993) Genetics 134: 917). The identification of AFLPs is discussed, for example, in EP 0 534 858 and U.S. Pat. No. 5,878,215.

In some embodiments, the methods are directed to breeding a plant line. Such methods use genetic polymorphisms identified as described above in a marker assisted breeding program to facilitate the development of lines that have a desired alteration in the salinity tolerance and/or oxidative stress tolerance trait(s). Once a suitable genetic polymorphism is identified as being associated with variation for the trait, one or more individual plants are identified that possess the polymorphic allele correlated with the desired variation. Those plants are then used in a breeding program to combine the polymorphic allele with a plurality of other alleles at other loci that are correlated with the desired variation. Techniques suitable for use in a plant breeding program are known in the art and include, without limitation, backcrossing, mass selection, pedigree breeding, bulk selection, crossing to another population and recurrent selection. These techniques can be used alone or in combination with one or more other techniques in a breeding program. Thus, each identified plants is selfed or crossed a different plant to produce seed which is then germinated to form progeny plants. At least one such progeny plant is then selfed or crossed with a different plant to form a subsequent progeny generation. The breeding program can repeat the steps of selfing or outcrossing for an additional 0 to 5 generations as appropriate in order to achieve the desired uniformity and stability in the resulting plant line, which retains the polymorphic allele. In most breeding programs, analysis for the particular polymorphic allele will be carried out in each generation, although analysis can be carried out in alternate generations if desired.

In some cases, selection for other useful traits is also carried out, e.g., selection for fungal resistance or bacterial resistance. Selection for such other traits can be carried out before, during or after identification of individual plants that possess the desired polymorphic allele.

VI. Articles of Manufacture

Transgenic plants provided herein have various uses in the agricultural and energy production industries. For example, transgenic plants described herein can be used to make animal feed and food products. Such plants, however, are often particularly useful as a feedstock for energy production.

Transgenic plants described herein often produce higher yields of grain and/or biomass per hectare, relative to control plants that lack the exogenous nucleic acid. In some embodiments, such transgenic plants provide equivalent or even increased yields of grain and/or biomass per hectare relative to control plants when grown under conditions of reduced inputs such as fertilizer and/or water. Thus, such transgenic plants can be used to provide yield stability at a lower input cost and/or under environmentally stressful conditions such as drought. In some embodiments, plants described herein have a composition that permits more efficient processing into free sugars, and subsequently ethanol, for energy production. In some embodiments, such plants provide higher yields of ethanol, butanol, other biofuel molecules, and/or sugar-derived co-products per kilogram of plant material, relative to control plants. By providing higher yields at an equivalent or even decreased cost of production relative to controls, the transgenic plants described herein improve profitability for farmers and processors as well as decrease costs to consumers.

Seeds from transgenic plants described herein can be conditioned and bagged in packaging material by means known in the art to form an article of manufacture. Packaging material such as paper and cloth are well known in the art. A package of seed can have a label, e.g., a tag or label secured to the packaging material, a label printed on the packaging material, or a label inserted within the package, that describes the nature of the seeds therein.

Enhanced salt and/or oxidative stress tolerance gives the opportunity to grow crops in saline or oxidative stress conditions without stunted growth and diminished yields due to salt-induced ion imbalance, disruption of water homeostasis, inhibition of metabolism, damage to membranes, and/or cell death. The ability to grow plants in saline or oxidative stress conditions would result in an overall expansion of arable land and increased output of land currently marginally productive due to elevated salinity or oxidative stress conditions.

Seed or seedling vigor is an important characteristic that can greatly influence successful growth of a plant, such as crop plants. Adverse environmental conditions, such as saline and/or oxidative conditions, can affect a plant growth cycle, germination of seeds and seedling vigor (i.e. vitality and strength under such conditions can differentiate between successful and failed plant growth). Seedling vigor has often been defined to comprise the seed properties that determine "the potential for rapid, uniform emergence and development of normal seedlings under a wide range of field conditions". Hence, it would be advantageous to develop plant seeds with increased vigor, particularly in elevated salinity and/or in oxidative stress conditions.

For example, increased seedling vigor would be advantageous for cereal plants such as rice, maize, wheat, etc. production. For these crops, germination and growth can often be slowed or stopped by salination and/or oxidation. Genes associated with increased seed vigor under saline and/or oxidative stress conditions have therefore been sought for producing improved plant varieties. (Walia et al. (2005) *Plant Physiology* 139:822-835).

The invention will be further described in the following examples, which do not limit the scope of the invention described in the claims.

VII. Examples

Example 1

*Agrobacterium*-Mediated Transformation of *Arabidopsis*

Host Plants and Transgenes: Wild-type *Arabidopsis thaliana* Wassilewskija (WS) plants were independently transformed with Ti plasmids containing clones encoding polypeptides at SEQ ID NOs: 43, 44, 45, 86, 136, 138, 140, 141, 142, 143, 144, and amino acid coordinates 1 to 135 of SEQ ID NO: 138. Examples include Ceres CLONE ID no. 1792354, Ceres SEEDLINE ID no. ME06748, Ceres SEEDLINE ID no. ME08768, Ceres SEEDLINE ID no. ME19173, and Ceres CLONE ID no. 375578. Unless otherwise indicated, each Ceres Clone and/or Seedline derived from a Clone is in the sense orientation relative to either the 35S promoter in a Ti plasmid. A Ti plasmid vector useful for these constructs, CRS 338, contains the Ceres-constructed, plant selectable marker gene phosphinothricin acetyltransferase (PAT), which confers herbicide resistance to transformed plants.

Preparation of Soil Mixture: 24 L Sunshine Mix #5 soil (Sun Gro Horticulture, Ltd., Bellevue, Wash.) is mixed with 16 L Therm-O-Rock vermiculite (Therm-O-Rock West, Inc., Chandler, Ariz.) in a cement mixer to make a 60:40 soil mixture. To the soil mixture is added 2 Tbsp Marathon 1% granules (Hummert, Earth City, Mo.), 3 Tbsp OSMO-COTE® 14-14-14 (Hummert, Earth City, Mo.) and 1 Tbsp Peters fertilizer 20-20-20 (J. R. Peters, Inc., Allentown, Pa.), which are first added to 3 gallons of water and then added to the soil and mixed thoroughly. Generally, 4-inch diameter pots are filled with soil mixture. Pots are then covered with 8-inch squares of nylon netting.

Planting: Using a 60 mL syringe, 35 mL of the seed mixture is aspirated. 25 drops are added to each pot. Clear propagation domes are placed on top of the pots that are then placed under 55% shade cloth and subirrigated by adding 1 inch of water.

Plant Maintenance: 3 to 4 days after planting, lids and shade cloth are removed. Plants are watered as needed. After 7-10 days, pots are thinned to 20 plants per pot using forceps. After 2 weeks, all plants are subirrigated with Peters fertilizer at a rate of 1 Tsp per gallon of water. When bolts are about 5-10 cm long, they are clipped between the first node and the base of stem to induce secondary bolts. Dipping infiltration is performed 6 to 7 days after clipping.

Preparation of *Agrobacterium*: To 150 mL fresh YEB is added 0.1 mL each of carbenicillin, spectinomycin and rifampicin (each at 100 mg/ml stock concentration). *Agrobacterium* starter blocks are obtained (96-well block with *Agrobacterium* cultures grown to an $OD_{600}$ of approximately 1.0) and inoculated one culture vessel per construct by transferring 1 mL from appropriate well in the starter block. Cultures are then incubated with shaking at 27° C. Cultures are spun down after attaining an $OD_{600}$ of approximately 1.0 (about 24 hours). 200 mL infiltration media is added to resuspend *Agrobacterium* pellets. Infiltration media is prepared by adding 2.2 g MS salts, 50 g sucrose, and 5 μL 2 mg/ml benzylaminopurine to 900 ml water.

Dipping Infiltration: The pots are inverted and submerged for 5 minutes so that the aerial portion of the plant is in the *Agrobacterium* suspension. Plants are allowed to grow normally and seed is collected.

Example 2

Saline Condition Screening

Saline condition screening: Screening is routinely performed by high-salt agar plate assay and also by high-salt soil assay. Traits assessed in high-salt conditions include: seedling area, photosynthesis efficiency, salt growth index and regeneration ability.

Seedling area: the total leaf area of a young plant about 2 weeks old.

Photosynthesis efficiency (Fv/Fm): Seedling photosynthetic efficiency, or electron transport via photosystem II, is estimated by the relationship between Fm, the maximum fluorescence signal and the variable fluorescence, Fv. Here, a reduction in the optimum quantum yield (Fv/Fm) indicates stress, and so can be used to monitor the performance of transgenic plants compared to non-transgenic plants under salt stress conditions.

Salt growth index=seedling area×photosynthesis efficiency (Fv/Fm).

Regeneration ability: the ability of a plant to regenerate shoots in saline soil after stems are cut off and the soil is irrigated with 200 mM NaCl solution.

Transformant identification: PCR was used to amplify the cDNA insert in one randomly chosen $T_2$ plant. This PCR product was then sequenced to confirm the sequence in the plants.

Identification of Tolerant Plant to Salt Stress: A superpool of seeds was screened for transgenic plants that show enhanced tolerance to SA, as detailed below, and high salt. Three independent candidate plants were sequenced and the transgene sequence matched ME02064.

Assessing Tolerance to Salt Stress: Generally, between four and ten independently transformed plant lines are selected and qualitatively evaluated for their tolerance to salt stress in the $T_1$ generation. Two or three of the transformed lines that qualitatively show the strongest tolerance to salt stress in the $T_1$ generation are selected for further evaluation in the $T_2$ and $T_3$ generations. This evaluation involves sowing seeds from the selected transformed plant lines on MS agar plates containing either 100 mM or 150 mM NaCl and incubating the seeds for 5 to 14 days to allow for germination and growth. For example, for ME02064 five T2 events were compared to wild-type Ws for salt stress tolerance on salt plates. Three events, ME02064-01, -03 and -04 were selected based on the measurement of seedling area on 36 plants of each event as compared to the control, Ws. Further evaluation of salt tolerance in ME02064-01, -03 and -04 was performed with $T_2$ and $T_3$ generations.

Calculating SGI: After germination and growth, seedling area and photosynthesis efficiency of transformed lines and a wild-type control are determined. From these measurements, the Salt Growth Index (SGI) is calculated and compared between wild-type and transformed seedlings. The SGI calculation is made by multiplying seedling area with photosynthesis efficiency measurements taken from two replicates of 36 seedlings for each transformed line and a wild-type control and performing a t-test.

Determining Transgene Copy Number: $T_2$ generation transformed plants are tested on BASTA™ plates in order to determine the transgene copy number of each transformed line. A BASTA™ resistant:BASTA™ sensitive segregation ratio of 15:1 generally indicates two copies of the transgene, and such a segregation ratio of 3:1 generally indicates one copy of the transgene.

Example 3

Oxidative Stress Conditions Screening

Under normal growth conditions, *Arabidopsis* rosette contains about 0.5 μg/g fresh weight of free SA. In response to stress conditions or pathogen attacks, the free SA levels can reach as high as 10 μg/g fresh weight, which is approximately equivalent to 60 μM. The exogenous application of 100-500 μM SA to *Arabidopsis* leaves by spraying is able to induce strong defense responses without triggering obvious necrotic lesion formation. Once the SA concentration increases to 5 mM or above, the cell death in form of necrotic lesions will appear on the sprayed leaves. If SA is applied through growth media, *Arabidopsis* is more sensitive to SA-induced oxidative stress, probably because of continuous absorption. The addition of 100-150 µM SA to growth media significant reduces plant growth but does not kills the plants in wild type *Arabidopsis* Ws. Therefore we use this range of SA to screen for enhanced oxidative stress tolerance.

Salicylic Acid Screening: Screening is routinely performed by agar plate assay using 100 µM or 150 µM exogenous sodium salicylate. Media contains ½X MS (Sigma), 150 µM sodium salicylate (Sigma), 0.5 g MES hydrate (Sigma) and 0.7% phytagar (EM Science), adjusted to pH 5.7 using 10N KOH.

To screen superpools, seeds are surface sterilized in 30% bleach solution for 5 minutes and then rinsed repeatedly with sterile water. Approximately 2500 seeds are sown on media plates in a monolayer at a density of 850 seeds per plate. Wild-type and positive controls are grown on comparable plates. Plates are wrapped with vent tape and placed at 4° C. in the dark for three days to stratify. At the end of this time, plates are transferred to a Conviron growth chamber set at 22° C., 16:8 hour light:dark cycle, 70% humidity with a combination of incandescent and fluorescent lamps emitting a light intensity of ~100 µEinsteins.

Seedlings are screened daily starting at 6 days. Seedlings that grow larger and stay greener compared to WS control plants are selected as positive candidates and transferred to soil for recovery and seed set.

Candidate plants are re-screened by placing 36 seeds from each candidate together with a WS control on the same sodium salicylate plate. Plates are treated as described above and seedling screening begun after at 4 days after germination. Leaf tissue is harvested from confirmed tolerant candidates for DNA extraction and amplification of the transgene by PCR.

Alternatively, superpool seeds are sown directly on soil and sprayed with 10 mM SA. Leaf tissue is harvested from tolerant candidate plants to isolate DNA for PCR amplification of the transgene and subsequent sequencing of the PCR product.

Traits assessed under sodium salicylate conditions include: seedling area, photosynthesis efficiency, salicylic acid growth index (SAG) and regeneration ability.

Seedling area: the total leaf area of a young plant about 2 weeks old.

Photosynthesis efficiency (Fv/Fm): Seedling photosynthetic efficiency, or electron transport via photosystem II, is estimated by the relationship between Fm, the maximum fluorescence signal and the variable fluorescence, Fv. Here, a reduction in the optimum quantum yield (Fv/Fm) indicates stress, and so can be used to monitor the performance of transgenic plants compared to non-transgenic plants under oxidative stress conditions.

Salicylic Acid Growth (SAG) Index=seedling area ($cm^2$)× photosynthesis efficiency (Fv/Fm).

PCR was used to amplify the cDNA insert in one randomly chosen $T_2$ plant. This PCR product was then sequenced to confirm the sequence in the plants.

Assessing Tolerance to Oxidative Stress: Initially, All available independently transformed T2 plant lines are qualitatively evaluated for their tolerance to oxidative stress as compared to wild-type controls. The positive transgenic lines that qualitatively show the strongest tolerance to oxidative stress are selected for further evaluation in the $T_2$ and $T_3$ generations using internal non-transgenic segregants as controls. This evaluation involves sowing seeds from the selected transformed plant lines on MS agar plates containing 100 µM or 150 µM sodium salicylate and incubating the seeds for at least 4 days to allow for germination and growth and transgene status analysis.

Calculating SAG: After germination and growth, seedling area and photosynthesis efficiency of transformed lines and a wild-type control are determined. From these measurements, the Salicylic Acid Growth Index (SAG) is calculated and compared between wild-type and transformed seedlings. The SAG calculation is made by multiplying seedling area with photosynthesis efficiency measurements taken from two replicates of 36 seedlings for each transformed line and a wild-type control and performing a t-test.

Determining Transgene Copy Number: $T_2$ generation transformed plants are tested on BASTA™ plates in order to determine the transgene copy number of each transformed line. A BASTA™ resistant:BASTA™ sensitive segregation ratio of 15:1 generally indicates two copies of the transgene, and such a segregation ratio of 3:1 generally indicates one copy of the transgene.

In some cases, validation is performed using media that is further supplemented with 100 uM SNP.

Example 4

ME02064 (Ceres Clone 375578; SEQ ID NO.139)

Wild-type *Arabidopsis thaliana* Wassilewskija was transformed with a Ti plasmid carrying the 35S promoter and Ceres Clone 375578. Three transformed lines, ME02064-01 and ME02064-03, ME02064-04, showed the strongest qualitative tolerance to salt stress in a prevalidation assay (Table 4-1). Their tolerance to 150 mM NaCl was further evaluated in a validation assay for two generations. Segregation ratios (BASTA™ resistant: BASTA™ sensitive) indicated ME02064-01 and ME02064-03, ME02064-04 transformed lines each carry one copy of the transgene.

TABLE 4-1

Prevalidation assay of ME02064 salt tolerance as compared to wild-type Ws

| | Ws Wild-type | ME02064-01 | ME02064-02 | ME02064-03 | ME02064-04 | ME02064-05 |
|---|---|---|---|---|---|---|
| Mean* | 0.0359 | 0.0435 | 0.0346 | 0.0441 | 0.0438 | 0.0305 |
| Standard Error | 0.0016 | 0.0048 | 0.004 | 0.0041 | 0.0035 | 0.0019 |

*Average seedling area of 36 plants grown on MS agar plates containing 150 mM NaCl for 14 days When grown on MS agar plates containing 150 mM NaCl, ME02064-01 and ME02064-03, ME02064-04 transgenic plants showed significantly greater seedling area and SGI relative to non-transgenic plants. As shown in Table 4-2, the T2-generation SGI value for ME02064-01 seedlings increased by 110% while ME02064-03 seedlings increased by 131% and ME02064-04 seedlings increased by 72% compared to non-transgenic control seedlings. In the $T_3$ generation, the SGI increase was 43% for ME02064-01, 47% for ME02064-03, and 64% for ME02064-04. The differences between transgenic and non-transgenic seedlings are statistically significant, and clearly demonstrate that the enhanced tolerance to salt stress was a result of the ectopic expression of Ceres Clone 375578 in the ME02064 transformant lines.

TABLE 4-2

Validation assay of ME02064 on salt tolerance in two generations

| ME Events | SGI* of transgenics | | | SGI of pooled non-transgenics | | | t-Test | | % of SGI increase |
|---|---|---|---|---|---|---|---|---|---|
| | Avg | SE | N | Avg | SE | N | t-value | $t_{0.05}$ | |
| ME02064-01-$T_2$ | 2.057 | 0.249 | 12 | 0.977 | 0.205 | 17 | 3.35 | 1.70 | 110.5 |
| ME02064-03-$T_2$ | 2.237 | 0.371 | 5 | 0.968 | 0.140 | 24 | 3.20 | 1.70 | 131.1 |
| ME02064-04-$T_2$ | 1.810 | 0.146 | 14 | 1.055 | 0.135 | 13 | 3.81 | 1.70 | 71.6 |
| ME02064-01-$T_3$ | 2.438 | 0.170 | 21 | 1.708 | 0.289 | 9 | 2.18 | 1.70 | 42.7 |
| ME02064-03-$T_3$ | 2.837 | 0.257 | 20 | 1.927 | 0.271 | 14 | 2.43 | 1.70 | 47.2 |
| ME02064-04-$T_3$ | 2.770 | 0.318 | 16 | 1.688 | 0.188 | 19 | 2.93 | 1.70 | 64.1 |

*SGI (Salt Growth Index) = seedling area × Fv/Fm (photosynthesis efficiency)

Summary of Results:
Ectopic expression of Ceres Clone 375578 under the control of the 35S promoter enhances tolerance to salt stress that causes necrotic lesions and stunted growth in wild-type Ws seedlings.

Example 5

ME03140; Clone 375578; SEQ ID No. 142

Wild-type *Arabidopsis thaliana* Wassilewskija was transformed with a Ti plasmid carrying the 35S promoter operatively linked to Ceres Clone 375578 (SEQ ID NO: 142), and five transgenic lines, ME03140-01, ME03140-02, ME03140-03, ME03140-04 and ME03140-05 were investigated for tolerance to salt stress. When grown on MS agar plates containing 150 mM NaCl, these transgenic lines showed increased tolerance to salt stress in quantitative assays as compared to non-transgenic control seedlings.

When grown on MS agar plates containing 150 mM NaCl, ME03140-01, ME03140-02, ME03140-03, ME03140-04 and ME03140-05 transgenic plants showed significantly greater seedling area and SGI relative to non-transgenic plants. As shown in Table 5, the T2-generation SGI value for ME03140-01 seedlings increased 102.18%, ME03140-02 seedlings increased 60.78%, ME03140-03 seedlings increased 120.32%, ME03140-04 seedlings increased 45.07% and ME03140-05 seedlings increased 90.53% as compared to non-transgenic control seedlings. The differences in SGI values between transgenic and non-transgenic seedlings have statistically significant P values for all transgenic lines, and these quantitative experiments clearly demonstrate that ectopic expression of Ceres Clone 375578 confers enhanced tolerance to salt stress in transgenic seedlings.

TABLE 5

Validation assay of ME03140 salt stress tolerance in one generation

| ME Events | SGI* of transgenics | | | SGI of pooled non-transgenics | | | P value | % of SGI increase |
|---|---|---|---|---|---|---|---|---|
| | Avg | SE | N | Avg | SE | N | | |
| ME03140-01-$T_2$ | 4.34 | 0.590403017 | 17 | 2.15 | 0.478695 | 26 | 3.10E−03 | 102.18% |
| ME03140-02-$T_2$ | 4.09 | 0.395692005 | 18 | 2.54 | 0.367281 | 28 | 3.22E−03 | 60.78% |

TABLE 5-continued

Validation assay of ME03140 salt stress tolerance in one generation

| ME Events | SGI* of transgenics | | | SGI of pooled non-transgenics | | | P value | % of SGI increase |
|---|---|---|---|---|---|---|---|---|
| | Avg | SE | N | Avg | SE | N | | |
| ME03140-03-T$_2$ | 4.03 | 0.646365854 | 12 | 1.83 | 0.397508 | 36 | 2.86E−03 | 120.32% |
| ME03140-04-T$_2$ | 4.86 | 0.534320049 | 17 | 3.35 | 0.446161 | 36 | 1.74E−02 | 45.07% |
| ME03140-05-T$_2$ | 4.31 | 0.5237326 | 25 | 2.26 | 0.665646 | 20 | 9.91E−03 | 90.53% |

*SGI (Salt Growth Index) = seedling area × Fv/Fm (photosynthesis efficiency)

Summary of Results:

Ectopic expression of Ceres Clone 375578 under the control of the 35S promoter enhances tolerance to salt stress that causes necrotic lesions and stunted growth in wild-type Ws seedlings.

Example 6

ME08732; Clone 560066; SEQ ID No. 44

Wild-type *Arabidopsis thaliana* Wassilewskija was transformed with a Ti plasmid carrying the 35S promoter operatively linked to Ceres Clone 560066 (SEQ ID NO: 44), and three transgenic lines, ME08732-01, ME08732-02 and ME08732-03, were investigated for tolerance to salt stress. When grown on MS agar plates containing 150 mM NaCl, these transgenic lines showed increased tolerance to salt stress in quantitative assays as compared to non-transgenic control seedlings.

When grown on MS agar plates containing 150 mM NaCl, ME08732-01, ME08732-02 and ME08732-03 transgenic plants showed significantly greater seedling area and SGI relative to non-transgenic plants. As shown in Table 6, the T2-generation SGI value for ME08732-01 seedlings increased 88.35%, ME08732-02 seedlings increased 41.72% and ME08732-03 seedlings increased 26.23%, as compared to non-transgenic control seedlings. The differences in SGI values between transgenic and non-transgenic seedlings have statistically significant values for ME08732-01 and ME08732-02 transgenic lines, and these quantitative experiments clearly demonstrate that ectopic expression of Ceres Clone 560066 confers enhanced tolerance to salt stress in transgenic seedlings.

Summary of Results:

Ectopic expression of Ceres Clone 560066 under the control of the 35S promoter enhances tolerance to salt stress that causes necrotic lesions and stunted growth in wild-type Ws seedlings.

Example 7

ME08768; Clone 539458; SEQ ID No. 86

Wild-type *Arabidopsis thaliana* Wassilewskija was transformed with a Ti plasmid carrying the 35S promoter operatively linked to Ceres Clone 539458 (SEQ ID NO: 86), and five transgenic lines, ME08768-01, ME08768-02, ME08768-03, ME08768-04 and ME08768-05, were investigated for tolerance to salt stress. When grown on MS agar plates containing 150 mM NaCl, these transgenic lines showed increased tolerance to salt stress in quantitative assays as compared to non-transgenic control seedlings.

When grown on MS agar plates containing 150 mM NaCl, ME08768-01, ME08768-02, ME08768-03, ME08768-04 and ME08768-05 transgenic plants showed significantly greater seedling area and SGI relative to non-transgenic plants. As shown in Table 7, the T2-generation SGI value for ME08768-01 seedlings increased 80.04%, ME008768-02 seedlings increased 111.63%, ME008768-03 seedlings increased 22.62%, ME008768-04 seedlings increased 115.40% and ME008768-05 seedlings increased 74.41% as compared to non-transgenic control seedlings. The differences in SGI values between transgenic and non-transgenic seedlings have statistically significant P values for

TABLE 6

Validation assay of ME08732 salt stress tolerance in one generation

| ME Events | SGI* of transgenics | | | SGI of pooled non-transgenics | | | P value | % of SGI increase |
|---|---|---|---|---|---|---|---|---|
| | Avg | SE | N | Avg | SE | N | | |
| ME08732-01-T$_2$ | 4.07 | 0.164301729 | 24 | 2.16 | 0.472565 | 14 | 2.57E−04 | 88.35% |
| ME08732-02-T$_2$ | 3.42 | 0.391450599 | 21 | 2.41 | 0.336042 | 26 | 2.86E−02 | 41.72% |
| ME08732-03-T$_2$ | 4.71 | 0.566761111 | 10 | 3.73 | 0.285925 | 52 | 6.44E−02 | 26.23% |

*SGI (Salt Growth Index) = seedling area × Fv/Fm (photosynthesis efficiency)

ME08768-01, ME08768-02, ME08768-04 and ME08768-05 transgenic lines, and these quantitative experiments clearly demonstrate that ectopic expression of Ceres Clone 539458 confers enhanced tolerance to salt stress in transgenic seedlings.

TABLE 7

Validation assay of ME08768 salt stress tolerance in one generation

| ME Events | SGI* of transgenics | | | SGI of pooled non-transgenics | | | P value | % of SGI increase |
|---|---|---|---|---|---|---|---|---|
| | Avg | SE | N | Avg | SE | N | | |
| ME08768-01-$T_2$ | 14.48 | 1.254125111 | 20 | 8.04 | 1.321838 | 26 | 4.91E-04 | 80.04% |
| ME08768-02-$T_2$ | 11.09 | 0.822117225 | 20 | 5.24 | 0.751908 | 32 | 1.55E-06 | 111.63% |
| ME08768-03-$T_2$ | 13.72 | 1.676864172 | 21 | 11.19 | 1.57188 | 30 | 0.1380406 | 22.62% |
| ME08768-04-$T_2$ | 14.82 | 1.3958585 | 16 | 6.88 | 0.777162 | 40 | 3.58E-06 | 115.40% |
| ME08768-05-$T_2$ | 10.02 | 1.365308 | 13 | 5.75 | 0.751134 | 38 | 4.23E-03 | 74.41% |

*SGI (Salt Growth Index) = seedling area × Fv/Fm (photosynthesis efficiency)

Summary of Results:

Ectopic expression of Ceres Clone 539458 under the control of the 35S promoter enhances tolerance to salt stress that causes necrotic lesions and stunted growth in wild-type Ws seedlings.

Example 8

ME10681; Clone 335348 SEQ ID No. 141

Wild-type *Arabidopsis thaliana* Wassilewskija was transformed with a Ti plasmid carrying the 35S promoter operatively linked to Ceres Clone 335348 (SEQ ID NO: 141), and six transgenic lines, ME10681-01-$T_2$, ME10681-01-T3, ME10681-02-$T_2$, ME10681-02-T3, ME10681-04-$T_2$ and ME10681-05-$T_2$, were investigated for tolerance to salt stress. When grown on MS agar plates containing 150 mM NaCl, these transgenic lines showed increased tolerance to salt stress in quantitative assays as compared to non-transgenic control seedlings.

When grown on MS agar plates containing 150 mM NaCl, ME10681-01-$T_2$, ME10681-01-$T_3$, ME10681-02-$T_2$, ME10681-02-$T_3$, ME10681-04-$T_2$ and ME10681-05-$T_2$ transgenic plants showed significantly greater seedling area and SGI relative to non-transgenic plants. As shown in Table 8, the T2-generation SGI value for ME010681-01-$T_2$ seedlings increased 39.17%, ME010681-01-$T_3$ seedlings increased 19.77%%, ME10681-02-$T_2$ seedlings increased 119.17%, ME10681-02-$T_3$ seedlings increased 6.21%, ME010681-04-$T_2$ seedlings increased 113.51% and ME010681-05-$T_2$ seedlings increased 103.98%, as compared to non-transgenic control seedlings. The differences in SGI values between transgenic and non-transgenic seedlings have statistically significant P values for ME10681-01-$T_3$, ME10681-02-$T_2$, ME10681-04-$T_2$ and ME10681-05-$T_2$ transgenic lines, and these quantitative experiments clearly demonstrate that ectopic expression of Ceres Clone 335348 confers enhanced tolerance to salt stress in transgenic seedlings.

TABLE 8

Validation assay of ME10681 salt stress tolerance in two generations

| ME Events | SGI* of transgenics | | | SGI of pooled non-transgenics | | | P value | % of SGI increase |
|---|---|---|---|---|---|---|---|---|
| | Avg | SE | N | Avg | SE | N | | |
| ME10681-01-$T_2$ | 3.87 | 0.683711333 | 9 | 2.78 | 0.302501 | 48 | 7.54E−02 | 39.17% |
| ME10681-01-$T_3$ | 4.7 | 0.31544415 | 23 | 3.93 | 0.3015141 | 43 | 3.99E−02 | 19.77% |
| ME10681-02-$T_2$ | 4.13 | 0.3353564 | 25 | 1.89 | 0.3969 | 22 | 4.16E−05 | 119.17% |
| ME10681-02-$T_3$ | 3.65 | 0.258400663 | 31 | 3.44 | 0.3060094 | 34 | 0.2980488 | 6.21% |
| ME10681-04-$T_2$ | 6.22 | 0.478672159 | 12 | 2.91 | 0.39405 | 30 | 2.04E−06 | 113.51% |
| ME10681-05-$T_2$ | 5.25 | 0.391550037 | 20 | 2.57 | 0.4265902 | 30 | 1.44E−05 | 103.98% |

*SGI (Salt Growth Index) = seedling area × Fv/Fm (photosynthesis efficiency)

Summary of Results:

Ectopic expression of Ceres Clone 335348 under the control of the 35S promoter enhances tolerance to salt stress that causes necrotic lesions and stunted growth in wild-type Ws seedlings.

Example 9

ME18973; Ceres cDNA ID 23457556; SEQ ID No.43

Wild-type *Arabidopsis thaliana* Wassilewskija was transformed with a Ti plasmid carrying the 35S promoter operatively linked to Ceres cDNA ID 23457556 (SEQ ID NO: 43), and six transgenic lines, ME18973-01-$T_2$, ME18973-02-$T_2$, ME18973-02-01-$T_3$, ME18973-03-$T_2$, ME18973-05-$T_2$ and ME18973-05-03-$T_3$ were investigated for tolerance to salt stress. When grown on MS agar plates containing 150 mM NaCl, these transgenic lines showed increased tolerance to salt stress in quantitative assays as compared to non-transgenic control seedlings.

When grown on MS agar plates containing 150 mM NaCl, ME18973-01, ME18973-02-$T_2$, ME18973-02-01-$T_3$, ME18973-03-$T_2$, ME18973-05-$T_2$ and ME18973-05-03-$T_3$ transgenic plants showed significantly greater seedling area and SGI relative to non-transgenic plants. As shown in Table 9, the T2 & T3-generation SGI value for ME018973-01-$T_2$ seedlings increased 230.01%, ME18973-02-$T_2$ seedlings increased 22.44%, ME18973-$O_2$-01-$T_3$ seedlings increased 14.96%, ME18973-05-$T_2$ seedlings increased 16.12% and ME18973-05-03-$T_3$ seedlings increased 13.97%, as compared to non-transgenic control seedlings. The differences in SGI values between transgenic and non-transgenic seedlings have statistically significant P values for the ME18973 transgenic lines, and these quantitative experiments clearly demonstrate that ectopic expression of Ceres cDNA ID 23457556 results in enhanced tolerance to salt stress in transgenic seedlings.

TABLE 9

Validation assay of ME18973 salt stress tolerance in two generations

| ME Events | SGI* of transgenics | | | SGI of pooled non-transgenics | | | P value | % of SGI increase |
|---|---|---|---|---|---|---|---|---|
| | Avg | SE | N | Avg | SE | N | | |
| ME18973-01-$T_2$ | 4.41 | 0.253654648 | 26 | 1.34 | 0.367022 | 18 | 1.03E−08 | 230.01% |
| ME18973-02-$T_2$ | 4.47 | 0.373604899 | 27 | 3.65 | 0.526316 | 18 | 0.1058348 | 22.44% |
| ME18973-02-01-$T_3$ | 4.82 | 0.205971746 | 44 | 4.19 | 0.3832982 | 25 | 7.71E−02 | 14.96% |
| ME18973-05-$T_2$ | 4.74 | 0 | 1 | 4.09 | 0.503725 | 26 | 0.160517 | 16.12% |
| ME18973-05-03-$T_3$ | 4.38 | 0.233610226 | 32 | 3.84 | 0.503725 | 37 | 6.89E−02 | 13.97% |

*SGI (Salt Growth Index) = seedling area × Fv/Fm (photosynthesis efficiency)

Summary of Results:

Ectopic expression of Ceres cDNA ID 23457556 under the control of the 35S promoter enhances tolerance to salt stress that causes necrotic lesions and stunted growth in wild-type Ws seedlings.

Example 10

ME19657; cDNA ID 23621377; SEQ ID No.45

Wild-type *Arabidopsis thaliana* Wassilewskija was transformed with a Ti plasmid carrying the 35S promoter operatively linked to Ceres cDNA ID 23621377 (SEQ ID NO: 45), and two transgenic lines, ME19657-01-$T_2$, ME19657-01-05-$T_3$, ME19657-01-08-$T_3$, ME19657-02-$T_2$, ME19657-03-$T_2$, ME19657-04-$T_2$ and ME19657-04-01-$T_3$, were investigated for tolerance to salt stress. When grown on MS agar plates containing 150 mM NaCl, these transgenic lines showed increase tolerance to salt stress in quantitative assays as compared to non-transgenic control seedlings.

When grown on MS agar plates containing 150 mM NaCl, ME19657-01-$T_2$, ME19657-01-05-$T_3$, ME19657-01-08-$T_3$, ME19657-02-$T_2$, ME19657-03-$T_2$, ME19657-04-$T_2$ and ME19657-04-01-$T_3$ transgenic plants showed significantly greater seedling area and SGI relative to non-transgenic plants. As shown in Table 10, the T2 & T3-generation SGI value for ME19657-01-$T_2$ seedlings increased 82.29%, ME19657-01-05-$T_3$ seedlings increased 82.29%, ME19657-01-08-$T_3$ seedlings increased 21.90%, ME19657-02-$T_2$ seedlings increased 39.50%, ME19657-03-$T_2$ seedlings increased 98.28%, and ME19657-04-$T_2$ seedlings increased 4.38% and ME19657-04-01-$T_2$ seedlings increased 7.44%, as compared to non-transgenic control seedlings. The differences in SGI values between transgenic and non-transgenic seedlings have statistically significant P values for ME19657-01-$T_2$, ME19657-01-05-$T_3$, ME19657-01-08-$T_3$, ME19657-02-$T_2$ and ME19657-03-$T_2$ transgenic lines, and these quantitative experiments clearly demonstrate that ectopic expression of Ceres cDNA ID 23621377 results in enhanced tolerance to salt stress in transgenic seedlings.

TABLE 10

Validation assay of ME19657 salt stress tolerance in two generations

| ME Events | SGI* of transgenics | | | SGI of pooled non-transgenics | | | P value | % of SGI increase |
|---|---|---|---|---|---|---|---|---|
| | Avg | SE | N | Avg | SE | N | | |
| ME19657-01-$T_2$ | 4.54 | 0.311964078 | 21 | 2.49 | 0.539972 | 15 | 5.62E−05 | 82.29% |
| ME19657-01-05-$T_3$ | 0.7 | 0.311964078 | 21 | 0.7 | 0.5399721 | 15 | 1.18E−03 | 82.29% |
| ME19657-01-08-$T_3$ | 5.4 | 0.278520121 | 27 | 4.43 | 0.3061552 | 36 | 1.18E−03 | 21.90% |
| ME19657-02-$T_2$ | 3.97 | 0.32089576 | 23 | 2.84 | 0.527849 | 18 | 0.0111868 | 39.50% |
| ME19657-03-$T_2$ | 4.79 | 0.313786256 | 22 | 2.41 | 0.299954 | 22 | 3.83E−02 | 98.28% |
| ME19657-04-$T_2$ | 3.67 | 0.341681304 | 15 | 3.52 | 0.324049 | 40 | 1.15E−06 | 4.38% |
| ME19657-04-01-$T_3$ | 4.56 | 0.495154 | 9 | 4.25 | 0.3487774 | 37 | 0.3723989 | 7.44% |

*SGI (Salt Growth Index) = seedling area × Fv/Fm (photosynthesis efficiency)

Summary of Results:
Ectopic expression of Ceres cDNA ID 23621377 under the control of the 35S promoter enhances tolerance to salt stress that causes necrotic lesions and stunted growth in wild-type Ws seedlings.

Example 11

ME24076; Clone 229668; SEQ ID No. 143

Wild-type *Arabidopsis thaliana* Wassilewskija was transformed with a Ti plasmid carrying the 35S promoter operatively linked to Ceres Clone: 229668 (SEQ ID NO: 143), and two transgenic lines, ME24076-01 and ME24076-02, were investigated for tolerance to salt stress. When grown on MS agar plates containing 150 mM NaCl, these transgenic lines showed increase tolerance to salt stress in quantitative assays as compared to non-transgenic control seedlings.

When grown on MS agar plates containing 150 mM NaCl, only ME024076-01-$T_2$ and transgenic plants showed significantly greater seedling area and SGI relative to non-transgenic plants. As shown in Table 11, the T2-generation SGI value for ME24076-01-$T_2$ seedlings increased 65.57% and ME24076-02-$T_2$ seedlings decreased by 1.12%, as compared to non-transgenic control seedlings. The differences in SGI values between transgenic and non-transgenic seedlings have statistically significant P values for transgenic line ME24076-01, and these quantitative experiments clearly demonstrate that ectopic expression of Ceres Clone 229668 results in enhanced tolerance to salt stress in transgenic seedlings.

Summary of Results:
Ectopic expression of Ceres Clone 229668 under the control of the 35S promoter enhances tolerance to salt stress that causes necrotic lesions and stunted growth in wild-type Ws seedlings.

Example 12

ME24217; Clone 375578; SEQ ID No. 144

Wild-type *Arabidopsis thaliana* Wassilewskija was transformed with a Ti plasmid carrying the 35S promoter operatively linked to Ceres Clone 375578 (SEQ ID NO: 144), and two transgenic lines, ME24217-07-$T_2$ and ME24217-09-$T_2$, were investigated for tolerance to salt stress. When grown on MS agar plates containing 150 mM NaCl, these transgenic lines showed increase tolerance to salt stress in quantitative assays as compared to non-transgenic control seedlings.

When grown on MS agar plates containing 150 mM NaCl, ME24217-07-$T_2$ and ME24217-09-$T_2$ transgenic plants showed significantly greater seedling area and SGI relative to non-transgenic plants. As shown in Table 12, the T2-generation SGI value for ME24217-07 seedlings increased 30.41% and ME24217-09 seedlings increased 134.46%, as compared to non-transgenic control seedlings. The differences in SGI values between transgenic and non-transgenic seedlings have statistically significant P values for ME24217-07-$T_2$ and ME24217-09-$T_2$ transgenic lines, and these quantitative experiments clearly demonstrate that ectopic expression of Ceres Clone 375578 results in enhanced tolerance to salt stress in transgenic seedlings.

TABLE 11

Validation assay of ME24076 salt stress tolerance in one generation

| ME Events | SGI* of transgenics | | | SGI of pooled non-transgenics | | | P value | % of SGI increase |
|---|---|---|---|---|---|---|---|---|
| | Avg | SE | N | Avg | SE | N | | |
| ME24076-01-$T_2$ | 11.18 | 0.924279499 | 17 | 6.75 | 0.9761984 | 32 | 9.45E−04 | 65.57% |
| ME24076-02-$T_2$ | 0.7 | 0.082529059 | 10 | 0.7 | 0.0506174 | 48 | 0.4675565 | −1.12% |

*SGI (Salt Growth Index) = seedling area × Fv/Fm (photosynthesis efficiency)

TABLE 12

Validation assay of ME24217 salt stress tolerance in one generation

| ME Events | SGI* of transgenics | | | SGI of pooled non-transgenics | | | P value | % of SGI increase |
|---|---|---|---|---|---|---|---|---|
| | Avg | SE | N | Avg | SE | N | | |
| ME24217-07-T$_2$ | 4.69 | 0.413823734 | 20 | 3.6 | 0.4284669 | 30 | 3.62E−02 | 30.41% |
| ME24217-09-T$_2$ | 4.92 | 0.446345081 | 22 | 2.1 | 0.506974 | 22 | 7.20E−05 | 134.46% |

*SGI (Salt Growth Index) = seedling area × Fv/Fm (photosynthesis efficiency)

Summary of Results:
Ectopic expression of Ceres Clone 375578 under the control of the 35S promoter enhances tolerance to salt stress that causes necrotic lesions and stunted growth in wild-type Ws seedlings.

Summary of Results:
Ectopic expression of Ceres Clone 375578 under the control of the 35S might not promote enhances tolerance to salt stress that causes necrotic lesions and stunted growth in wild-type Ws seedlings.

Example 13

ME02064C; Clone 375578C; SEQ ID No. 138

Wild-type *Arabidopsis thaliana* Wassilewskija was transformed with a Ti plasmid carrying the 35S promoter operatively linked to Ceres Clone 375578 (SEQ ID NO: 138), and six transgenic lines, ME02064C-01-T$_2$, ME02064C-02-T$_2$, ME02064C-03-T$_2$, ME02064C-04-T$_2$, ME02064C-05-T$_2$ and ME02064C-06-T$_2$ were investigated for tolerance to salt stress. When grown on MS agar plates containing 150 mM NaCl, most of these transgenic lines did not show tolerance to salt stress in quantitative assays as compared to non-transgenic control seedlings.

Table 13 shows that, when grown on MS agar plates containing 100 mM NaCl, the T2-generation SGI value for: ME02064C-01-T$_2$ seedlings as compared to non-transgenic control seedlings was 0.55%; ME02064C-02-T$_2$ seedlings as compared to non-transgenic control seedlings was 1.31%; ME02064C-03-T$_2$ seedlings as compared to non-transgenic control seedlings was 9.67%; ME02064C-04-T$_2$ seedlings as compared to non-transgenic control seedlings was −7.78%; ME02064C-05-T$_2$ seedlings as compared to non-transgenic control seedlings was −15.77%; and ME02064C-06-T$_2$ seedlings as compared to non-transgenic control seedlings 17.78%.

Example 14

ME02064P1; Clone 375578P1—Amino Acids 1 to 135 of SEQ ID No. 138

Wild-type *Arabidopsis thaliana* Wassilewskija was transformed with a Ti plasmid carrying the 35S promoter operatively linked to a nucleic acid encoding Ceres Clone 375578P1 (amino acids 1 to 135 of SEQ ID NO: 138), a 3' truncation variant of Ceres Clone 375578 described above in Example 1. Five transgenic lines, ME02064P1-03-T$_2$, ME02064P1-07-T$_2$, ME02064P1-09-T$_2$, ME02064P1-10-T$_2$ and ME02064P1-15-T$_2$ were investigated for tolerance to salt stress. All five of these transgenic lines showed tolerance to salt stress in quantitative assays as compared to non-transgenic control seedlings. As shown in Table 10, the T2-generation SGI value for ME02064P1 seedlings increased by 32.57%, 89.52%, 66.84%, 25.43%, 36.95%. compared to non-transgenic control seedlings.

When grown on MS agar plates containing 150 mM NaCl, ME02064P1-03, ME02064P1-07, ME02064P1-09, ME02064P1-10 and ME02064P1-15 transgenic plants showed significantly greater seedling area and SGI relative to non-transgenic plants. As shown in Table 14, the T2-generation SGI value for ME02064P1-03 seedlings increased 32.57%, ME02064P1-07 seedlings increased 89.52%,

TABLE 13

Validation assay of ME02064C salt stress tolerance in one generation

| ME Events | SGI* of transgenics | | | SGI of pooled non-transgenics | | | P value | % of SGI increase |
|---|---|---|---|---|---|---|---|---|
| | Avg | SE | N | Avg | SE | N | | |
| ME02064C-01-T$_2$ | 10.89 | 0.735174679 | 33 | 10.83 | 0.707901 | 34 | 0.4769106 | 0.55% |
| ME02064C-02-T$_2$ | 10.7 | 0.595225094 | 50 | 10.56 | 0.971548 | 21 | 0.4517289 | 1.31% |
| ME02064C-03-T$_2$ | 9.39 | 0.582009053 | 48 | 8.56 | 0.958475 | 23 | 0.2314441 | 9.67% |
| ME02064C-04-T$_2$ | 10.66 | 0.555387069 | 51 | 11.56 | 1.046386 | 21 | 0.2252269 | −7.78% |
| ME02064C-05-T$_2$ | 10.84 | 0.60377588 | 48 | 12.87 | 0.839921 | 24 | 2.68E−02 | −15.77% |
| ME02064C-06-T$_2$ | 12.55 | 0.608556025 | 44 | 10.65 | 0.764179 | 28 | 2.83E−02 | 17.78% |

*SGI (Salt Growth Index) = seedling area × Fv/Fm (photosynthesis efficiency)

ME02064P1-09 seedlings increased 66.84%, ME02064P1-10 seedlings increased 25.43% and ME02064P1-15 seedlings increased 36.95% as compared to non-transgenic control seedlings. The differences in SGI values between transgenic and non-transgenic seedlings have statistically significant under P values for transgenic lines ME02064P1-03-$T_2$, ME02064P1-07-$T_2$, ME02064P1-09-$T_2$, ME02064P1-10-$T_2$ and ME02064P1-15-$T_2$, and these quantitative experiments clearly demonstrate that ectopic expression of Ceres Clone 37558P1 results in enhanced tolerance to salt stress in transgenic seedlings.

ME02064P2-09-$T_2$ did show statistically significant salt tolerance in quantitative assays as compared to non-transgenic control seedlings; and one transgenic lines, ME02064P2-10-$T_2$, showed statistically significant reduction in salt tolerance as compared to non-transgenic control seedlings.

Table 15 shows that, when grown on MS agar plates containing 100 mM NaCl, the T2-generation SGI value for: ME02064P2-01-$T_2$ seedlings as compared to non-transgenic control seedlings was 1.62%, ME02064P2-04-$T_2$ seedlings as compared to non-transgenic control seedlings was

TABLE 14

Validation assay of ME02064P1 salt stress tolerance in one generation

| ME Events | SGI* of transgenics | | | SGI of pooled non-transgenics | | | P value | % of SGI increase |
|---|---|---|---|---|---|---|---|---|
| | Avg | SE | N | Avg | SE | N | | |
| ME02064P1-03-$T_2$ | 10.76 | 0.507929031 | 47 | 8.12 | 0.925474 | 25 | 7.29E−03 | 32.57% |
| ME02064P1-07-$T_2$ | 13.26 | 0.561088966 | 54 | 7 | 1.165372 | 16 | 3.87E−06 | 89.52% |
| ME02064P1-09-$T_2$ | 12.23 | 0.654850534 | 54 | 7.33 | 1.141553 | 17 | 1.99E−04 | 66.84% |
| ME02064P1-10-$T_2$ | 15.63 | 0.570291003 | 40 | 12.46 | 0.845552 | 32 | 1.36E−03 | 25.43% |
| ME02064P1-15-$T_2$ | 11.84 | 0.607966 | 42 | 8.64 | 0.959856 | 30 | 3.20E−03 | 36.95% |

*SGI (Salt Growth Index) = seedling area × Fv/Fm (photosynthesis efficiency)

Summary of Results:

Ectopic expression of Clone 375587P1 under the control of the 35S promoter enhances tolerance to salt stress.

Example 15

ME02064P2; Clone 375578P2—Amino Acids 188 to 498 of SEQ ID No.138

Wild-type *Arabidopsis thaliana* Wassilewskija was transformed with a Ti plasmid carrying the 35S promoter and a nucleic acid encoding Ceres Clone 375578P2 (amino acids 188 to 498 of SEQ ID NO: 138), a 5' truncation variant of Ceres Clone 375578 described above in Example 1. Eight ME02064P2 transgenic lines were investigated for tolerance to salt. Four transgenic lines, ME02064P2-01-$T_2$, ME02064CP2-04-$T_2$, ME02064P2-05-$T_2$, ME02064P2-06-$T_2$ ME02064P2-07-$T_2$, ME02064P2-$T_2$-08 and 20.31%, ME02064P2-05-$T_2$ seedlings as compared to non-transgenic control seedlings was 31.24%, ME02064P2-06-$T_2$ seedlings as compared to non-transgenic control seedlings was 41.14%, ME02064P2-07-$T_2$ seedlings as compared to non-transgenic control seedlings was 15.91%, ME02064P2-08-$T_2$ seedlings as compared to non-transgenic control seedlings was 40.82%, ME02064P2-09-$T_2$ seedlings as compared to non-transgenic control seedlings was 135.79%, and ME02064P2-10-$T_2$ was −12.36% as compared to non-transgenic control seedlings.

When grown on MS agar plates containing 100 mM NaCl, ME02064P2-01-$T_2$, ME02064P2-04-$T_2$, ME02064P2-05-$T_2$, ME02064P2-06-$T_2$, ME02064P2-07-$T_2$, ME02064P2-08-$T_2$ and ME02064P2-09-$T_2$ transgenic plants showed significantly greater seedling area and SGI relative to non-transgenic plants. However as shown in Table 3, the T2-generation SGI value for ME02064P2-10-$T_2$ seedlings showed a decrease in SGI compared to non-transgenic control seedlings.

TABLE 15

Validation assay of ME02064P2 on salt tolerance in one generation

| ME Events | SGI* of transgenics | | | SGI of pooled non-transgenics | | | P value | % of SGI increase |
|---|---|---|---|---|---|---|---|---|
| | Avg | SE | N | Avg | SE | N | | |
| ME02064P2-01-$T_2$ | 9.84 | 0.687493743 | 53 | 9.68 | 1.261045 | 19 | 0.4567634 | 1.62% |
| ME02064P2-04-$T_2$ | 5.2 | 0.558723451 | 47 | 4.32 | 0.560634 | 25 | 0.1357713 | 20.31% |
| ME02064P2-05-$T_2$ | 8.42 | 0.714218299 | 45 | 6.41 | 0.623421 | 27 | 0.0190578 | 31.24% |
| ME02064P2-06-$T_2$ | 8.56 | 0.515029349 | 48 | 6.07 | 0.654098 | 24 | 1.88E−03 | 41.14% |
| ME02064P2-07-$T_2$ | 12.3 | 0.647077232 | 47 | 10.61 | 0.8768 | 25 | 6.29E−02 | 15.91% |
| ME02064P2-08-$T_2$ | 9.16 | 0.724681422 | 37 | 6.51 | 0.73405 | 35 | 6.08E−03 | 40.82% |
| ME02064P2-09-$T_2$ | 5.72 | 0.489863069 | 47 | 2.43 | 0.182583 | 24 | 1.19E−08 | 135.79% |
| ME02064P2-10-$T_2$ | 9.32 | 0.908174851 | 21 | 10.63 | 0.70877 | 51 | 0.1289273 | 12.36% |

*SGI (Salt Growth Index) = seedling area × Fv/Fm (photosynthesis efficiency)

Summary of Results:

Ectopic expression of Clone 375587P2 under the control of the 35S promoter enhances tolerance to salt stress. Ceres Clone 375578P2 retains the α-β domains of Ceres Clone 375578 located within amino acid residues 137-157 of SEQ ID NO: 138) but does not retain the Σ-r domains of Ceres Clone 375578 of SEQ ID NO: 138.

Example 16

ME10681; Clone 335348 SEQ ID No. 141

Wild-type *Arabidopsis thaliana* Wassilewskija was transformed with a Ti plasmid carrying the 35S promoter operatively linked to Ceres cDNA 335348 (SEQ ID NO: 141).

Wildtype Ws seedlings showed necrotic lesions and stunted growth on plates containing 100 or 150 μM SA, whereas the transgenic plants showed significantly better growth.

Three transformed lines, ME10681-01, ME10681-02 and ME10681-05, were quantitatively studied by growth on MS agar plates containing 100 μM SA. After 14 days, plates were scanned using an EPSON color scanner or fluorescence scanner and SAGI calculated for each plant. The data is summarized in Table 16.

When grown on MS agar plates containing 100 μM SA, ME10681-02-$T_2$ and ME10681-05-$T_2$ transgenic plants showed significantly increased seedling area and SAGI relative to non-transgenic plants. However ME10681-01-$T_2$ showed a slight decrease in SAGI relative to non-transgenic plants. As shown in Table 12, the $T_2$ generation SAGI value for ME10681-01-$T_2$, ME10681-02-$T_2$ and ME10681-05-$T_2$ seedlings was −3.29%, 17.65% and 51.84%, respectively. The differences between transgenic and non-transgenic seedlings have statistically significant P values for lines ME10681-02-$T_2$ and ME10681-05-$T_2$, and clearly demonstrate enhanced tolerance to oxidative stress is a result of the ectopic expression of Ceres cDNA 36505846 in the ME10681 transformant lines.

Summary of Results:

In sum, ectopic expression of Ceres Clone 335348 under the control of the 35S promoter enhances oxidative stress tolerance that causes necrotic lesions and stunted growth in wild-type WS seedlings.

Example 17

ME24091; Clone 106263; SEQ ID No. 136

Wild-type *Arabidopsis thaliana* Wassilewskija was transformed with a Ti plasmid carrying the 35S promoter operatively linked to Ceres cDNA 016263 (SEQ ID NO: 135). Wildtype Ws seedlings showed necrotic lesions and stunted growth on plates containing 100 or 150 μM SA, whereas the transgenic plants showed significantly better growth.

Ten transformed lines, ME24091-01-$T_2$, ME24091-02-$T_2$, ME24091-03-$T_2$, ME24091-04-$T_2$ ME24091-05-$T_2$, ME24091-06-$T_2$ ME24091-07-$T_2$, ME24091-08-$T_2$, ME24091-09-$T_2$ and ME24091-10-$T_2$, were quantitatively studied by growth on MS agar plates containing 100 μM SA. After 14 days, plates were scanned using an EPSON color scanner or fluorescence scanner and SAGI calculated for each plant.

When grown on MS agar plates containing 100 μM SA, ME24091-01-$T_2$, ME24091-02-$T_2$, ME24091-03-$T_2$, ME24091-04-01-$T_3$, ME24091-04-$T_2$, ME24091-05-01-$T_3$, ME24091-05-$T_2$, ME24091-06-01, ME24091-06, ME24091-07-01, ME24091-07, ME24091-08-01, ME24091-08, ME24091-09-01, ME24091-09, ME24091-10-01 and ME24091-10 transgenic plants showed significantly increased seedling area and SAGI relative to non-transgenic plants. As shown in Table 17, the $T_2$ generation SAGI value for ME24091-01, ME24091-02, ME24091-03, ME24091-04 ME24091-05, ME24091-06 ME24091-07, ME24091-08, ME24091-09 and ME24091-10 seedlings increased by 119.47%, 198.00% and 133.67%, 241.50%, 143.70% and 248.12%, 186.59%, 188.86%, 285.42% and 180.46% respectively. The differences between transgenic and non-transgenic seedlings have statistically significant P values for transgenic lines ME24091-01, ME24091-02, ME24091-03, ME24091-04-01, ME24091-04 ME24091-05-01, ME24091-05, ME24091-06-01, ME24091-06, ME24091-07-01, ME24091-07, ME24091-08, ME24091-09-01, ME24091-09, and ME24091-10, and clearly demonstrate that the enhanced tolerance to oxidative stress is a result of the ectopic expression of Ceres Clone 106263 in the ME24091 transformant lines.

TABLE 16

Salicylic acid validation assay of ME10681 in one generation

| ME Events | Seedling area of transgenics | | | Seedling area of pooled non-transgenics | | | P value | % Seedling area increase |
|---|---|---|---|---|---|---|---|---|
| | Avg | SE | N | Avg | SE | N | | |
| ME10681-01-$T_2$ | 0.56 | 0.096445 | 18 | 0.58 | 0.061856 | 53 | 0.434159 | −3.29% |
| ME10681-02-$T_2$ | 0.67 | 0.06042 | 38 | 0.38 | 0.079644 | 32 | 0.002198 | 17.65% |
| ME10681-05-$T_2$ | 0.68 | 0.072271 | 43 | 0.45 | 0.108539 | 25 | 0.039761 | 51.84% |

TABLE 17

Salicylic acid validation assay of ME24091 in two generations

| ME Events | Seedling area of transgenics | | | Seedling area of pooled non-transgenics | | | P value | % Seedling area increase |
|---|---|---|---|---|---|---|---|---|
| | Avg | SE | N | Avg | SE | N | | |
| ME24091-01-$T_2$ | 0.69 | 0.055882059 | 29 | 0.58 | 0.070002209 | 38 | 0.105475324 | 19.47% |
| ME24091-02-$T_2$ | 0.44 | 0.050576014 | 41 | 0.22 | 0.054717602 | 27 | 0.002577564 | 98.00% |
| ME24091-03-$T_2$ | 0.58 | 0.054269056 | 43 | 0.44 | 0.085715224 | 26 | 0.076183067 | 33.67% |
| ME24091-04-$T_2$ | 0.54 | 0.050859903 | 45 | 0.22 | 0.077668008 | 19 | 0.000634704 | 141.50% |
| ME24091-04-01-$T_3$ | 0.39 | 0.07715765 | 20 | 0.24 | 0.07271465 | 20 | 0.081950663 | 61.93% |
| ME24091-05-$T_2$ | 0.55 | 0.048581793 | 42 | 0.38 | 0.072915009 | 27 | 0.029849118 | 43.70% |
| ME24091-05-01-$T_3$ | 0.38 | 0.068463201 | 21 | 0.15 | 0.05109963 | 30 | 0.005958129 | 144.90% |
| ME24091-06-$T_2$ | 0.71 | 0.049360913 | 39 | 0.29 | 0.063969074 | 23 | 1.13831E−06 | 148.12% |
| ME24091-06-01-$T_2$ | 0.49 | 0.073404661 | 19 | 0.22 | 0.063271768 | 22 | 0.004691952 | 118.19% |
| ME24091-07-$T_2$ | 0.69 | 0.054095931 | 37 | 0.37 | 0.07390372 | 25 | 0.000414138 | 86.59% |
| ME24091-07-01-$T_3$ | 0.49 | 0.052850446 | 33 | 0.19 | 0.049649799 | 22 | 5.3153E−05 | 162.61% |
| ME24091-08-$T_2$ | 0.64 | 0.059981819 | 24 | 0.34 | 0.071776729 | 23 | 0.00111815 | 88.86% |
| ME24091-08-01-$T_3$ | 0.44 | 0.050181996 | 27 | 0.40 | 0.074557785 | 26 | 0.306877156 | 11.48% |
| ME24091-09-$T_2$ | 0.81 | 0.056031311 | 38 | 0.29 | 0.067403065 | 22 | 5.88685E−08 | 185.42% |
| ME24091-09-01-$T_3$ | 0.45 | 0.055439617 | 36 | 0.28 | 0.05131548 | 31 | 0.0116714 | 62.95% |
| ME24091-10-$T_2$ | 0.56 | 0.048643058 | 39 | 0.31 | 0.062146975 | 29 | 0.001240527 | 80.46% |
| ME24091-10-01-$T_3$ | 0.36 | 0.051198395 | 31 | 0.26 | 0.066281225 | 22 | 0.114418402 | 39.44% |

Summary of Results:
In sum, ectopic expression of Ceres cDNA Clone 106263 under the control of the 35S promoter enhances oxidative stress tolerance that causes necrotic lesions and stunted growth in wild-type Ws seedlings.

Example 18

Determination of Functional Homologs by Reciprocal BLAST

A candidate sequence was considered a functional homolog of a reference sequence if the candidate and reference sequences encoded proteins having a similar function and/or activity. A process known as Reciprocal BLAST (Rivera et al., *Proc. Natl. Acad. Sci. USA*, 95:6239-6244 (1998)) was used to identify potential functional homolog sequences from databases consisting of all available public and proprietary peptide sequences, including NR from NCBI and peptide translations from Ceres clones.

Before starting a Reciprocal BLAST process, a specific reference polypeptide was searched against all peptides from its source species using BLAST in order to identify polypeptides having BLAST sequence identity of 80% or greater to the reference polypeptide and an alignment length of 85% or greater along the shorter sequence in the alignment. The reference polypeptide and any of the aforementioned identified polypeptides were designated as a cluster.

The BLASTP version 2.0 program from Washington University at Saint Louis, Mo., USA was used to determine BLAST sequence identity and E-value. The BLASTP version 2.0 program includes the following parameters: 1) an E-value cutoff of 1.0e-5; 2) a word size of 5; and 3) the -postsw option. The BLAST sequence identity was calculated based on the alignment of the first BLAST HSP (High-scoring Segment Pairs) of the identified potential functional homolog sequence with a specific reference polypeptide. The number of identically matched residues in the BLAST HSP alignment was divided by the HSP length, and then multiplied by 100 to get the BLAST sequence identity. The HSP length typically included gaps in the alignment, but in some cases gaps were excluded.

The main Reciprocal BLAST process consists of two rounds of BLAST searches; forward search and reverse search. In the forward search step, a reference polypeptide sequence, "polypeptide A," from source species SA was BLASTed against all protein sequences from a species of interest. Top hits were determined using an E-value cutoff of $10^{-5}$ and a sequence identity cutoff of 35%. Among the top hits, the sequence having the lowest E-value was designated as the best hit, and considered a potential functional homolog or ortholog. Any other top hit that had a sequence identity of 80% or greater to the best hit or to the original reference polypeptide was considered a potential functional homolog or ortholog as well. This process was repeated for all species of interest.

In the reverse search round, the top hits identified in the forward search from all species were BLASTed against all protein sequences from the source species SA. A top hit from the forward search that returned a polypeptide from the aforementioned cluster as its best hit was also considered as a potential functional homolog.

Functional homologs were identified by manual inspection of potential functional homolog sequences. Representative functional homologs for SEQ ID Nos. 2, 35, 41, 43, 44, 45, 86, 109, 135, 136, 138, 140, 141, 142, 143 are shown in FIGS. 1-6 and the Sequence Listing.

Example 19

Determination of Functional Homologs by Hidden Markov Models

Hidden Markov Models (HMMs) were generated by the program HMMER 2.3.2. To generate each HMM, the default HMMER 2.3.2 program parameters, configured for local alignments, were used.

An HMM was generated using the sequences shown in FIG. 1 as input. These sequences were input into the model and the HMM bit score for each sequence is shown in the Sequence Listing. Additional sequences were input into the model, and the HMM bit scores for the additional sequences are shown in the Sequence Listing. The results indicate that these additional sequences are functional homologs of SEQ ID NO: 86.

HMMs were also generated using the sequences shown in FIGS. 2-6 as input. These sequences were input into the respective models and the corresponding HMM bit score for each sequence is shown in the Sequence Listing. Additional sequences were input into the models, and the HMM bit scores for the additional sequences are shown in the Sequence Listing. The results indicate that these additional sequences are functional homologs of the groups in FIGS. 2-6.

In an alternative embodiment, the HMM is generated with the proviso that none of the amino acids specifically described in PCT/US2007/06544 are used. In particular the following amino acids appearing in the Sequence Listing of PCT/US2007/06544 are excluded: SEQ ID NO:99, SEQ ID NO:100, SEQ ID NO:102, SEQ ID NO:103, SEQ ID NO:104, SEQ ID NO:180, SEQ ID NO:252, SEQ ID NO:298, SEQ ID NO:300, SEQ ID NO:301, SEQ ID NO:306 and SEQ ID NO:312.

REFERENCES

The following references are cited in the Specification. Each of the references from the patent and periodical literature cited herein is hereby expressly incorporated in its entirety by such citation.

Zhang et al. (2004) *Plant Physiol.* 135:615.
Salomon et al. (1984) *EMBO J.* 3:141.
Herrera-Estrella et al. (1983) *EMBO J.* 2:987.
Escudero et al. (1996) *Plant J.* 10:355.
Ishida et al. (1996) *Nature Biotechnology* 14:745.
May et al. (1995) *Bio/Technology* 13:486)
Armaleo et al. (1990) *Current Genetics* 17:97.
Smith. T. F. and Waterman, M. S. (1981) *Adv. App. Math.* 2:482.
Needleman and Wunsch (1970) *J. Mol. Biol.* 48:443.
Pearson and Lipman (1988) *Proc. Natl. Acad. Sci.* (*USA*) 85: 2444.
Yamauchi et al. (1996) *Plant Mol. Biol.* 30:321-9.
Xu et al. (1995) *Plant Mol. Biol.* 27:237.
Yamamoto et al. (1991) *Plant Cell* 3:371.
P. Tijessen, "Hybridization with Nucleic Acid Probes" In Laboratory Techniques in Biochemistry and Molecular Biology, P. C. vand der Vliet, ed., c. 1993 by Elsevier, Amsterdam.
Bonner et al., (1973) *J. Mol. Biol.* 81:123.
Sambrook et al., Molecular Cloning: A Laboratory Manual, Second Edition, Cold Spring Harbor Laboratory Press, 1989, New York.
Shizuya et al. (1992) *Proc. Natl. Acad. Sci. USA,* 89: 8794-8797.
Hamilton et al. (1996) *Proc. Natl. Acad. Sci. USA,* 93: 9975-9979.
Burke et al. (1987) *Science,* 236:806-812.
Sternberg N. et al. (1990) *Proc Nall Acad Sci USA.,* 87:103-7.
Bradshaw et al. (1995) *Nucl Acids Res,* 23: 4850-4856.
Frischauf et al. (1983) *J. Mol. Biol,* 170: 827-842.
Huynh et al., Glover N M (ed) DNA Cloning: A practical Approach, Vol. 1 Oxford: IRL Press (1985).
Walden et al. (1990) *Mol Cell Biol* 1: 175-194.
Vissenberg et al. (2005) *Plant Cell Physiol* 46:192.
Husebye et al. (2002) *Plant Physiol* 128:1180.
Plesch et al. (2001) *Plant J* 28:455.
Weising et al. (1988) *Ann. Rev. Genet.,* 22:421.
Christou (1995) *Euphytica, v.* 85, n.1-3:13-27.
Newell (2000)
Griesbach (1987) *Plant Sci.* 50:69-77.
Fromm et al. (1985) *Proc. Natl. Acad. Sci. USA* 82:5824.
Paszkowski et al. (1984) *EMBO J.* 3:2717.
Klein et al. (1987) *Nature* 327:773.
Willmitzer, L. (1993) Transgenic Plants. In: iotechnology, A Multi-Volume Comprehensive treatise (H.J. Rehm, G. Reed, A. Püler, P. Stadler, eds., Vol. 2, 627-659, VCH Weinheim-New York-Basel-Cambridge). *Crit. Rev. Plant. Sci.* 4:1-46.
Fromm et al. (1990) *Biotechnology* 8:833-844.
Cho et al. (2000) *Planta* 210:195-204.
Brootghaerts et al. (2005) *Nature* 433:629-633.
Lincoln et al. (1998) *Plant Mol. Biol. Rep.* 16:1-4.
Lacomme et al. (2001), "Genetically Engineered Viruses" (C. J. A. Ring and E. D. Blair, Eds). Pp. 59-99, BIOS Scientific Publishers, Ltd. Oxford, UK.
Huh G H, Damsz B, Matsumoto T K, Reddy M P, Rus A M, Ibeas J I, Narasimhan M L, Bressan R A, Hasegawa P M, 2002, Salt causes ion disequilibrium-induced programmed cell death in yeast and plants. *Plant J* 29(5): 649-59.
Kang D K, Li X M, Ochi K, Horinouchi S, 1999, Possible involvement of cAMP in aerial mycelium formation and secondary metabolism in *Streptomyces griseus. Microbiology,* 145 (Pt 5):1161-72.
Kerk D, Bulgrien J, Smith D W, Gribskov M, 2003, *Arabidopsis* proteins containing similarity to the universal stress protein domain of bacteria. *Plant Physiol.* 131(3): 1209-19.
Zhu J K, 2001, Cell signaling under salt, water and cold stresses. *Curr Opin Plant Biol.* 4(5):401-6.
Susstrunk U, Pidoux J, Taubert S, Ullmann A, Thompson C J, 1998, Pleiotropic effects of cAMP on germination, antibiotic biosynthesis and morphological development in *Streptomyces coelicolor. Mol Microbiol* 30(1): 33-46.
Davletova S, Schlauch K, Coutu J, Mittler R., 2005, The zinc-finger protein Zat12 plays a central role in reactive oxygen and abiotic stress signaling in *Arabidopsis. Plant Physiol* 139(2): 847-56.
Fowler S G, Cook D, Thomashow M F., 2005, Low temperature induction of *Arabidopsis* CBF1, 2, and 3 is gated by the circadian clock. *Plant Physiol* 137(3):961-8.
Nachin L, Nannmark U, Nystom T (2005) Differential roles of the universal stress proteins of *Escherichia coli* in oxidative stress resistance, adhesion and motility *J Bacteriol* 187(18):6265-72.
Rizhsky L, Davletova S, Liang H, Mittler R, 2004, The zinc finger protein Zat12 is required for cytosolic ascorbate peroxidase 1 expression during oxidative stress in *Arabidopsis. J Biol. Chem.* 19; 279(12): 11736-43.
Vogel J T, Zarka D G, Van Buskirk H A, Fowler S G, Thomashow M F, 2005, Roles of the CBF2 and ZAT12 transcription factors in configuring the low temperature transcriptome of *Arabidopsis. Plant J.* 41(2): 195-211.
Sanchez-Barrena M J, Martinez-Ripoll M, Zhu J K, Albert A., 2005, The structure of the *Arabidopsis thaliana* SOS3: molecular mechanism of sensing calcium for salt stress response *J Mol. Biol.* 345(5):1253-64.
Griffen, H. G, and Gasson, M. J. (1995) The Gene (aroK) Encoding Shikimate Kinase I from *E. Coli. DNA Seq.,* 5(3):195-197.
Susstrunk et al. (1998) *Mol Microbiol,* 30(1):33-46
Kang et al. (1999) *Microbiology,* 145:1161-72.
Sauter M, Rzewuski G, Marwedel T, Lorbiecke R (2002) The novel ethylene-regulated gene OsUsp1 from rice encodes a member of a plant protein family related to prokaryotic universal stress proteins. *J Exp Bot* 53 (379): 2325-31.
Kasuga et al. (1999) *Nature Biotech* 17: 287-291.
Rus et al. (2001) PNAS 98:14150-14155.
Shi et al. (2000) PNAS 97:6896-6901.
Apse et al. (1999) *Science* 285:1256-1258.
Zhang et al. (2001) PNAS 98:12832-12836.
Berthomieu et al. (2003) *EMBO J.* 22:2004-2014.
Ren et al. (2005) *Nat. Genet.* 37:1029-30
Davletova et al (2005) *Plant Physiol.* 139:847-56

SEQUENCE LISTING (168 sequences)

SEQ ID NO: 1 - DNA, 2343 bp, Panicum virgatum
  misc_feature: Ceres CLONE ID no.1792354
  misc_feature: Encodes the peptide sequence at SEQ ID NO. 2
agtgactagtgagctcactccctcctccttcccacttgactctgcccgccagctactgaaccaaccaacaaatacctccgggctccctccggctttgccactcccatggattggaggttggaggcctgaagggggaggtgggtcgccggacagggacggggagacggcgagagggcgttccgcaggagccgttcccgtgcttcctccaccgaccgggccgacgcgccgcgccgctgtttcaggttccagaatttcaagtattggccgctttaggatactatgggaaagtccccggggaagtggatcaagtctgtgctcttggggaagaaatcgactaaatccggttctaccaaggcaaatgagtcgaaggctacaaataacaatggacactcagctggggaggagcgtgcattttctgaaaattctccagtgatctctgagccggtgcttgttgaagcccacaaaaatggagctgtttcagttaatgggaaggctgaagatgtcaatttgccaagtgacagggctggccaacaagatctgcagaaccaaagtattgttgagtccgaaacatcagttcctgggcaattgggagaagaccaagctgcagtgaaggcacaggcagcatttcgcggttacctagcacgaaggtcattccgtgcattgaaaggtatcataagactccaggtactgattcgagggcatcttgtaaggagacaggctgtttcaacccttcgaactacttggttgattgtgaagtttcaatctctagttcgtggaagaaatgtcagactctctggtgctgacattcaactcaatgtgaagcttggccaacataaccttggtggcactagatcatctgatgcatggaaagagaagttatcttcaaatgcctatgttcggaagcttctgtcttcaccaatagtgctagaacctcttcacttccagtatgacaagagggatcccaattcaacctataactggctagagagatggaccataggctgcatctggaagcctgtttttcaaccaaaaagagttcctgatgggaaactgctggtaaggaaggctagttatgcaatggaaactgaatcagccaagttaaagcgcaacattaggaagggctctgctgctacagttgagagtttccatacaagagtgactggtgaatctgagaaacttaaacgtaatccaaagaaattctcaaacttccctgctgactcagtaccagatagccagttatctgaacttgagaaggttaaaaggaacctgaggaaggtaactgattccatggctgaagcctcaaagatctctagttccagggttgattcctcaaaggtatctgattctacacctgatgctccaaaagtatctaatcctgtggccgaaatctcaaagacatctagtctcctgaacgggatctctgaccatcaagacagccaatgtgaaaaagcactacagaatacacgtgaggcttcatttcctcttgaaactcaagattactctggcaatggtcagctattggaatattcagatatggataacttcgacttggtacctggtttgaaaagtgatctggaaactcagcttgattcagtttctataggagaaaatgttgatgagcccactgttggtgcttcagcagctgaaggtatgccactgcagaacattgatgagcccattagtttagggaagaaagaggaagcaaggtccaaggaagagcatctgtctaatggaagccttagaactggcaagagaaagtcttcatccccatacaaatcagaatatgtggaaaacgggactcacactactcctgctcagccaaggaagccaagctatatggctgcaacggagtctgcgaaggcgaaattacgagcacagaattcacccagggtggattctgattcatcagcagaaaagaatggcttcactcgacgccactctcttccttccggtacaaacagtagggcgatcaaagctgaatggaagcgctgaggaggcattgacttgaattgaatagtgcgattgtctgaatctctgctgggtgaactctgccgctgcttgctcctttttatttatcctgcgatgtaaagagaagacattgtccctgtattgaacaatctttgtgatgagtgcgtctggttcagtctgtggtaggttcacgtgccaggcctagtgccccgttcattgtatagtcacagttctctcgggattgaaatcgattcctcgtgtaagctgatgttaggactgcagtctgatcgaataacatcatccgcttgcacactgccttaagcccttaattgatatgataccgggcaatttcgtgaaaaaaaaaaaaaaaaaaaa

SEQ ID NO: 2 - protein, 570 aa, Panicum virgatum
  misc_feature: Ceres CLONE ID no.1792354
  misc_feature: Score of 822.8 for HMM of FIGURE 5.
  misc_feature (106)..(126): Pfam Name: IQ Pfam Description: IQ calmodulin-binding motif
MGKSPGKWIKSVLLGKKSTKSGSTKANESKATNNNGHSAGEERAFSENSPVISEPVLVEAHKNGAVSVNGKAEDVNLPSDRAGQQDLQNQSIVESETSVPGQLGEDQAAVKAQAAFRGYLARRSFRALKGIIRLQVLIRGHLVRRQAVSTLRTTWLIVKFQSLVRGRNVRLSGADIQLNVKLGQHNLGGTRSSDAWKEKLSSNAYVRKLLSSPIVLEPLHFQYDKRDPNSTYNWLERWTIGCIWKPVFQPKRVPDGKLLVRKASYAMETESAKLKRNIRKGSAATVESFHTRVTGESEKLKRNPKKFSNFPADSVPDSQLSELEKVKRNLRKVTDSMAEASKISSSRVDSSKVSDSTPDAPKVSNPVAEISKTSSLLNGISDHQDSQCEKALQNTREASFPLETQDYSGNGQLLEYSDMDNFDLVPGLKSDLETQLDSVSIGENVDEPTVGASAAEGMPLQNIDEPISLGKKEEARSKEEHLSNGSLRTGKRKSSSPYKSEYVENGTHTTPAQPRKPSYMAATESAKAKLRAQNSPRVDSDSSAEKNGFTRRHSLPSGTNSRAIKAEWKR

SEQ ID NO: 3 - DNA, 2278 bp, Gossypium hirsutum
  misc_feature: Ceres CLONE ID no.1925477
  misc_feature: Encodes the peptide sequence at SEQ ID NO 4
cccgctccattgatgtcactaaccctaattatacttacacacctacttctcttgtgattcattttacacatttaatttctgaaggccgttttcatctctttcttagcttttatttagttttaaattcactccaaaaaaaaaaaaaaaaacactgcacgggaatctcttgttcgaggaatccttcacggtacgaaattcgttcttcagatctctgaatgctcactgtttaactgttccttggttttttcttctggtaatggcagcttagtagcgaacaaggacttcaaatttgctgcatttttcagatttccagatttagaaacttggaattttaattatttttgggtctaacggagatgggaaaatctccagcaaaatggatcaagaccttacttcttgggaagaaatcttcaaagtccagtttctcaaaaggaaaagagaagctgaaatctgcaaataaaggtgaggttttggtttcttccaaggtgactgtgtctgacctatcagtggatcctccatcaatttcagcacctattctagtgaatagcgctaggaatgtggtggactctgagaagggtatacctgcccaattgccaaatgatggggcaaatattccatctccaaaagtggatggaaatgatgccacaactggtaattttggtaacccagaaaatcctgataggattgggcttgacccagctgctgtgacggtacaggctgctttcagaggttatctggctcgcagggcatttcgaaccctcaagggcattataaggctgcaagcagttattcgtggtcacttggttagaagacaagctgttgctactttatgctgtacatggggaattgttaagttgcaagcactagctcgtggtcaaaaggtcagatgttcagatattgccatggaaatacaagaaaaacatctaagactgcttcagggttctaaaagctcggattctattggagtgagcacatcttctaaggtgaagaatttatcaaataatgtgtttgttcagaagcttttggcctcatcaccttctgtattacctctacaacttcaatatgttccagaggagcctaactcatcctggcagtggcttctacgatggacaatgtcacatttttgggtatcccctttaaaaccagttaggagtggaaagacaaaacgaagtattcagaaactgtccaatgcaaaagttgttaatggatctagtcattctaccttggagcatgaaaaaaacaaacgaggtgtgaggagagtttctggcaactcagcagcagattcagttcggaagcatccacaaaatgagcttgagagggttaagcgcagtttacgaaagctttctgactcttcaaaggaggtttctgataagtctgaagtttttaatgagaaaacaaagaagactccgaaaaaaacttctaattctaatgaccctgatttttcagaacaggaatccgctgagaagataagagatgtgactgcaacactatcagaactgtcaattcttgaggcagatctgaaaatttccctagaagatccttctcttggtgagcctaatctctgtcctgcagttgatttgtcacctgctgaaaacaatcgtaaacttgaggtaatagaggagttaatctctaaagacaagcaggttggtgatgagagctcaaacacaagccaaagaagagcttctttccctgcaaaaattgataatcaggcgaatgggttaaatctcatgccaaaagtgcccagttatatggcagcaactgaatctgcaaaagctagacttaggggtcaaggctccccaatgtttaccccggaggctgttgagaaaaatgggttaaacaggcgatattctctgccatcttcaacctatagtaatacaagttcacagtccccacatggtcaaagacgggttcgagtagctggcaaaggtgctaacatcagtgacaaatctcaatcatcctctaaagatgctaatgataaggttgtcagagctgagtggaggaggtaattcttgcatggggaattgtttcgatgaagtttccatggagtttgtgcacggatgctacttaacaaaacttcccttatgtgttgtaaacttctgatgtttggttgtagaagcaggagagtgaatcatctaatcttttgttgcttggtgtatctttttaagtttccttggcactttcaggtttgtagatgggtaaatatttgtagatgttacagttggttatttggtttatttggttcgtttgtgtttgtacgcaaaaaaaaaaaaaaaaaaaa

SEQ ID NO: 4 - protein, 549 aa, Gossypium hirsutum
  misc_feature: Ceres CLONE ID no.1925477
  misc_feature: Score of 1112.9 for HMM of FIGURE 5.
  misc_feature: Functional Homolog Of Ceres CLONE ID no. 1792354 at SEQ ID NO. 2
  misc_feature (113)..(133): Pfam Name: IQ Pfam Description: IQ calmodulin-binding motif
MGKSPAKWIKTLLLGKKSSKSSFSKGKEKLKSANKGEVLVSSKVTVSDLSVDPPSISAPILVNSARNVVDSEKGIPAQLPNDGANIPSPKVDGNDATTGNFGNPENPDRIGLDPAAVTVQAAFRGYLARRAFRTLKGIIRLQAVIRGHLVRRQAVATLCCTWGIVKLQALARGQKVRCSDIAMEIQEKHLRLLQGSKSSDSIGVSTSSKVKNLSNNVFVQKLLASSPSVLPLQLQYVPEEPNSSWQWLLRWTMSHFWVSPLKPVRSGKTKRSIQKLSNAKVVNGSSHSTLEHEKNKRGVRRVSGNSAADSVRKHPQNELERVKRSLRKLSDSSKEVSDKSEVFNEKTKKTPKKTSNSNDPDFSEQESAEKIRDVTATLSELSILEADLKISLEDPSLGEPNLCPAVDLSPAENNRKLEVIEELISKDKQVGDESSNTSQRRASFPAKIDNQANGLNLMPKVPSYMAATESAKARLRGQGSPMFTPEAVEKNGLNRRYSLPSSTYSNTSSQSPHGQRRVRVAGKGANISDKSQSSSKDANDKVVRAEWRR

SEQ ID NO: 5 - DNA, 1908 bp, Populus balsamifera subsp. trichocarpa
  misc_feature: Ceres ANNOT ID no.1521592
  misc_feature: Encodes the peptide sequence at SEQ ID NO 6
atggggagaaaatcacctgcgaaatggataaagactgttttgtttggaaagaagtcttccaaatctcttattgtcaaaggaagggagagaactgtgaatgacaaagagacattggttgctgtcagagccgtggaagctgatgtgacctcagttcctccggtggtcaagccgacagcccccactaccactaatatcactgaaaggatgttagagctagagagcagggaaactacagaatcatcacgtgatggaggtatattgtcaactggaaatcaagatgcaaatcattctcaattatacactcctgatgctcctccatctgatgctgacaaaataaggcttgatgaagctgcgacaatggcacaagccgcatttaggggttacttggctcgccgagcatttcgagctcttaaaggcataataaggcttcaggctcttatccgtggacacttggttagaaggcaagctgttgctactctctgctgtgtgctcggagttgtcaagttacaggctcttgctcgaggaagaatggttaggaattcagagattggctatgaggttcataaattatgcagccaagtaaaactgccggagggcaagcttgcagattctagtggagttggtatacaaatggccaagctgtcatcaaatgcttttgttcgcaagcttcttgctccatcacctgctgtaatgcctttgcaactcccctatgattccatggaaccaaactcagttgcaaactggttagagtgctggtcagcgtcctctttctggaaaccagttccccaaccaaaaaaaattacttgctcaaaaactcagagaaagcagagtaatggtcaaatagtggaagctgaaactggtaggccaaagcgcactgttcggagggtccctgctgcaaatgttgacagtacctcagtacaagcagcctctgaatttgagaaacccaagcgcaatttgaggaaagtttcaagccatccagctgattcagcagaaaattcacagattgagcttgaaaaggtaaagcgcagcttaagaaaggttaataaccccgttatagaaaactctgctcattcagaggttgaaaatgaaaagccaaagcaaggtctagaaaaggtatctggcacttcaggtgataatgttttgggatggagcgtaagtaattcagctgagaagatgaagaaagaagctaccttgacaacatccaatgtacctgatgtggtgaagaatgatccaaacttgatgtccaagttgcctgatgcagagacagctgatgaacctgtagaaatgatcaaggcattggaatcatcacatgacgatcaagctgtggtagaatctaaagcttcagtagatactggtggtatagttgagaatatgcaaataaatgggaagtccatacaccaggatgatccaacaagcaatgaaaatcacaaaactgccaagaaaccttcattcacaatgaaaccagaacgtgccgagaatgggctacagagcagtcccaccctccctagctacatggcagcaactgaatctgcaaaggcaaagctgagaatgcaaggctccccaagatttagtgaagatcgagttgagaaaaataacatcacccgtcgtcattctctgccctcttcaactaatagcaaaatcagctccgagtccccgaggacacaaagagcagttcatggtagtggcaaaggggggaataagagtgacaagtctttattgtcttcaagagatggaaatgctaagggagcccaaccagagtggaagagatcatggtgtagcagtgaaacatggtctatagccggaagggggggaataaagagaaaagaaggaaaaaaaaataaaagtccaccaatgacaaaccaaccacctaacattgacacgcgtcgccccaaaataaagaggacatga

SEQ ID NO: 6 - protein, 589 aa, Populus balsamifera subsp. trichocarpa
  misc_feature: Ceres ANNOT ID no.1521592
  misc_feature: Score of 1414.1 for HMM of FIGURE 5.
  misc_feature: Functional Homolog Of Ceres CLONE ID no. 1792354 at SEQ ID NO. 2
  misc_feature (115)..(135): Pfam Name: IQ Pfam Description: IQ calmodulin-binding motif
MGRKSPAKWIKTVLFGKKSSKSLIVKGRERTVNDKETLVAVRAVEADVTSVPPVVKPTAPTTTNITERMLELESRETTESSRDGGILSTGNQDANHSQLYTPDAPPSDADKIRLDEAATMAQAAFRGYLARRAFRALKGIIRLQALIRGHLVRRQAVATLCCVLGVVKLQALARGRMVRNSEIGYEVHKLCSQVKLPEGKLADSSGVGIQMAKLSSNAFVRKLLAPSPAVMPLQLPYDSMEPNSVANWLECWSASSFWKPVPQPKKITCSKTQRKQSNGQIVEAETGRPKRTVRRVPAANVDSTSVQAASEFEKPKRNLRKVSSHPADSAENSQIELEKVKRSLRKVNNPVIENSAHSEVENEKPKQGLEKVSGTSGDNVLGWSVSNSAEKMKKEATLTTSNVPDVVKNDPNLMSKLPDAETADEPVEMIKALESSHDDQAVVESKASVDTGGIVENMQINGKSIHQDDPTSNENHKTAKKPSFTMKPERAENGLQSSPTLPSYMAATESAKAKLRMQGSPRFSEDRVEKNNITRRHSLPSSTNSKISSESPRTQRAVHGSGKGGNKSDKSLLSSRDGNAKGAQPEWKR

SEQ ID NO: 7 - DNA, 2059 bp, Glycine max
  misc_feature: Ceres CLONE ID no.463594
  misc_feature: Encodes the peptide sequence at SEQ ID NO 8
attgtttggttctggttctcaggaatggtagatttgaggtgaagacgttccacattggtcaggtcccgatctcacgatggggaagtcaccaggaaaatggatcaaaactgtactgttcgggaaaaagtcatctaaatcaaatatttcaaaaggcagagagaagcttgttaatcaaaaaggagtagtagttacctccaaggtgccagaaactggtttggctttagaaccaacctccgatactattgccagacatgaggaagatccagagctggaaaataaagaagcagaaaatgttttacccgggaatcaagaaatagacacagtgggatcaattaatgaagatgctgcactagatccagagaaaatgaggctggaggaagcagctacaaaggcacaagctgctttcaggggttatttggctcggagagcatttagggctctaaaaggaataataaggttgcaagcactcatccgtgggcacttggttaggagacaagctgttgttacattatgctcaatgtatggtattgtcaagtttcaagcacttgttcgtggaggaatagttagacagtctaatgttggatctgaaatccatgagaagtccaatatattgaaccctctggatggcaagcttgtcaagccaaatgctatgttcacgaaaattaccaagctgtctgcaaatgctttcattcggaagcttcttacttcgtcaactacaataatggcgctgcggttgcaatatgttcccggcgatccaaattcagtcctaagttggttggagcgctggtcagcatctcacttttggaaaccagttccccaacccaagaaaattcgagatactaagtctcagagaaagcatggcaatatttcagttggagatactcatgtgagcaagtcaaaacgaatcaacaggaagcttcctactgcaagttttgactcggtcccagtgcaagcaaatcctgaatttgaaaaaccaaaacgaaacacaaggaaaatttcaaaccaatcctcagatcctcatgtgcaggaaaacccacaaagtgagcttgaaaagattaaacgtaacttgagaaaggtttataacccagttgttgagaatgctgttccgtcagaagttgaatccgaaatgccaaaggatcatttggaaaaggtaacagttacctcatgccttgctgtttcagagcaagaggtcattagttctaatgagaagatcaagaaggaagcaatattaactgtttccagtgtgccagatatagaaactactccaagactttcagttagtaaggaggtgtctgacacaccaagcagttatcaagtgactgtggaatcaaaaccattgactgagattacaactaaagataaaaacatttctgtttctgacgaagtaaaaaatgagcccatagatttaccagagcctatttgtaaagatgaaaattctcacttaacaaatggagatttgagtcacaaggaagatcaaataggcagtgaaaaccagaaaccaaaccaaaaagcctcaattgtagcaaagcaggaacgtgcagagaatggtatacagaatagtccaacattaccgagttacatggcagcaactgaatctgcaaaggcaaagttgagggcacaaggatccccaagatttggacaggatggaagtgaaagaaacaaccatactcggcgacattctctgccatcctcaactaacagcaaaattaattcaccttcacctaggacacagagaccagttcaatcaggtggcaaaggtggccacagaagtgacagaactgtatcatcttctagagatgggaatggaaaggtaattcaagcagagtggaggcggtaatttgaggaaggccgatgttctggaggaacatgaggagggcgaaaccgtgtgtggtttatatgtatctttgatgagaattgttgaatggataggactataggtgtgcttgaattcaggttatttcttcatttgctgcattttgggctttgagggtgatttgtacattataggtttctagttttgcatgatgcaactataactaaatttaattatgttttaagc

SEQ ID NO: 8 - protein, 586 aa, Glycine max
  misc_feature: Ceres CLONE ID no.463594
  misc_feature: Score of 730.7 for HMM of FIGURE 5.
  misc_feature: Functional Homolog Of Ceres CLONE ID no. 1792354 at SEQ ID NO. 2
  misc_feature (100)..(120): Pfam Name: IQ Pfam Description: IQ calmodulin-binding motif
MGKSPGKWIKTVLFGKKSSKSNISKGREKLVNQKGVVVTSKVPETGLALEPTSDTIARHEEDPELENKEAENVLPGNQEIDTVGSINEDAALDPEKMRLEEAATKAQAAFRGYLARRAFRALKGIIRLQALIRGHLVRRQAVVTLCSMYGIVKFQALVRGGIVRQSNVGSEIHEKSNILNPLDGKLVKPNAMFTKITKLSANAFIRKLLTSSTTIMALRLQYVPGDPNSVLSWLERWSASHFWKPVPQPKKIRDTKSQRKHGNISVGDTHVSKSKRINRKLPTASFDSVPVQANPEFEKPKRNTRKISNQSSDPHVQENPQSELEKIKRNLRKVYNPVVENAVPSEVESEMPKDHLEKVTVTSCLAVSEQEVISSNEKIKKEAILTVSSVPDIETTPRLSVSKEVSDTPSSYQVTVESKPLTEITTKDKNISVSDEVKNEPIDLPEPICKDENSHLTNGDLSHKEDQIGSENQKPNQKASIVAKQERAENGIQNSPTLPSYMAATESAKAKLRAQGSPRFGQDGSERNNHTRRHSLPSSTNSKINSPSPRTQRPVQSGGKGGHRSDRTVSSSRDGNGKVIQAEWRR

SEQ ID NO: 9 - protein, 587 aa, Arabidopsis thaliana
  misc_feature: Public GI ID no.22330633
  misc_feature: Score of 545.5 for HMM of FIGURE 5.
  misc_feature: Functional Homolog Of Ceres CLONE ID no. 1792354 at SEQ ID NO. 2
  misc_feature (113)..(132): Pfam Name: IQ Pfam Description: IQ calmodulin-binding motif
MGKSTKWLKNVLLGKKTSKSSGSKDKERVVSGKEVLVTSKVEESDVVSDLPSFEVAETNTVDRSGGMLETQNVGPEEISDDEIELPEGKSTDSQNVAPVQDHSLSDAERIQREIAATSVQAAFRGYLARRAFWALKGIIRLQALIRGHLVRRQAVATLFSVMGIVRLQAFARGREIRKSDIGVQVYRKCRLQLLQGNKLANPTDAYLGIKKLTANAFAQKLLASSPKVLPVHAYDTSNPNSNLIWLENWSASCFWKPVPQPKKTISRKPQNRLLVEAESAKPKKSVRKVPASNFESSSVQTSFEFEKPKRSFRKVSSQSIEPPAVEDPQIELEKVKRSLRKVHNPVVESSIQPQRSPRKEVEKPKLGVEKTRESSYPLVHETAEEPVNVCDEKKKQEISEQPEEEVHALEMEVHTPGPLETNEALDSSLVNQIDSNEKAMVEEKPSMEKDTKEEKTPKPNNKENSAGKENQKSRKKGSATSKTEREESNGHHETSPSIPSYMQATKSAKAKLRLQGSPKSAEQDGTEKATVPRRHSLPSPGNGRITSHSPRTTRLANSGDKTGNKKEKPLLSSREGNAKTTPAERKR

SEQ ID NO: 10 - DNA, 2049 bp, Zea mays
  misc_feature: Ceres CLONE ID no.345954
  misc_feature: Encodes the peptide sequence at SEQ ID NO 11
gtttttcgccgagcagttcgcgtgctcccctccacaggccgacgcggcgacgccgctgtttcaggttctggaatttccagtgcgggtgcattaggctgctatgggcaagtcgccggggaagtggatcaaatcggtgcttttggggaagaaatctaccaagtcaggtcctaccaagtcgaatgaatctaaggctgacaacaacagatactcgaccggggaggaccgcacattgtctgagagttctcctgtgatttctgagccggtactagttaacatccacaagaacgtagctatcaatgggaaggctgcagatgccagtgatagggcacggcaacaagatccgcagagccaaagcgttgttgagtccagatcatcggctccagctgctcagctgggagaagatcaagctgcagcgaaggcacaggcagcctttcgtggttacctggcacgaaggtcattccgtgcattaaaaggtatcgtaagactccaggcgctgattcgagggtatcttgtaaggaggcaggctgtatcaacccttcgcgcaacatggttgattgtgaagtttcaggctctagttcgtggaagaaatgttagactctctggcagtcgcatgcagctcaatgtgaagtttggtcagagtaactttgggggtgttagatcgtctgatgcatggaaagagaagctatcttcaaatgcttatgttcggaagcttctgtcttcaccaattgttttagaacctcttcacttccagtatgacaagagggatcccaattcaacctataactggtttgagagatggaccataggttgcatctggaagcctgcttttcaacccaaaagagttgctgatgggaaaccactggtaaagaaggctagttatgcaatggaaactcaatcagccaagttaaaacgcaacattcggaagggttctgctgctatcgctgggagtttccatacatctggtgaatctgataaagtaaaaaggaatccaaagaatttctctagcttccctgctgattcagtaccagatagccagttatctgaacttgaaaaggttaaaaggaacctcaggaaggtaactgattcgatggctgaagcctcaaagatatctagttccagggttgattcctcgaaggtatgtaattctacagctgaggttccaaaggaatctaatcctgtggcagaaatctcaaagatacgtagtctcctgaatgggatctctgaccatcaggatattcaatgtgagaatacacgtgaatcttcatttcctcttggaactcaagaagactctgacaatgatcatctattgcgatattcaaatatggatagcttggacttggtacctggtttgaaaagtgatcaggaaattcagctggattcggtttctataggagaaaatgttgatgatcccactgttgttgctccagcagttgaagaaatgtcaccgcaaaacattgatacggaagacaatgttttatgcaagaaagaggaagcaaggtccaaggaagagcacttgtctaatggaagccttagaactagcaagaggaagtcttcattccccaacaaatcagaatatgtagaaaatgggactcacgctactcctgttcagccaacgcagccaagctatatggctgcaacggagtccgcaaaggcgaaattgcgagcccagaattcacccagtctggattctgattcagcggcagaaaagaatggtttcacccgacgccactctcttccttccagtacaaagagtagagcacttaaagctgaatggaagcgctgaagaggcaacccatcgtccacttgaattgaattgtgcactgctctgaaacttcgctggatgaactcgaccggtcttgtcccatgttcttgctgtattgaacaaccccttgtgaagttgcgattctggttcagtttgtcgtaggttcatgtgcaaccactagtgccttgtgtcgtatattgcatggttcttgtcgaaggaacaatgcctgcgaaagctgatgttaggactgcattaactgaataacatcacccagttgcccaggtctt

SEQ ID NO: 11 - protein, 560 aa, Zea mays
  misc_feature: Ceres CLONE ID no.345954
  misc_feature: Score of 757.6 for HMM of FIGURE 5.
  misc_feature: Functional Homolog Of Ceres CLONE ID no. 1792354 at SEQ ID NO. 2
  misc_feature (101)..(121): Pfam Name: IQ Pfam Description: IQ calmodulin-binding motif
MGKSPGKWIKSVLLGKKSTKSGPTKSNESKADNNRYSTGEDRTLSESSPVISEPVLVNIHKNVAINGKAADASDRARQQDPQSQSVVESRSSAPAAQLGEDQAAAKAQAAFRGYLARRSFRALKGIVRLQALIRGYLVRRQAVSTLRATWLIVKFQALVRGRNVRLSGSRMQLNVKFGQSNFGGVRSSDAWKEKLSSNAYVRKLLSSPIVLEPLHFQYDKRDPNSTYNWFERWTIGCIWKPAFQPKRVADGKPLVKKASYAMETQSAKLKRNIRKGSAAIAGSFHTSGESDKVKRNPKNFSSFPADSVPDSQLSELEKVKRNLRKVTDSMAEASKISSSRVDSSKVCNSTAEVPKESNPVAEISKIRSLLNGISDHQDIQCENTRESSFPLGTQEDSDNDHLLRYSNMDSLDLVPGLKSDQEIQLDSVSIGENVDDPTVVAPAVEEMSPQNIDTEDNVLCKKEEARSKEEHLSNGSLRTSKRKSSFPNKSEYVENGTHATPVQPTQPSYMAATESAKAKLRAQNSPSLDSDSAAEKNGFTRRHSLPSSTKSRALKAEWKR

SEQ ID NO: 12 - DNA, 2049 bp, Zea mays; identical to SEQ ID NO: 10
  misc_feature: Ceres CLONE ID no.345954
  misc_feature: Encodes the peptide sequence at SEQ ID NO 11

SEQ ID NO: 13 - protein, 574 aa, Zea mays
  misc_feature: Ceres LOCUS ID no. Os01m05025_AP003288
  misc_feature: Score of 858.7for HMM of FIGURE 5.
  misc_feature: Functional Homolog Of Ceres CLONE ID no. 1792354 at SEQ ID NO. 2
  misc_feature (98)..(118): Pfam Name: IQ Pfam Description: IQ calmodulin-binding motif
MGKSPAKWIKSVLLGKKSAKSNSTKAKDLAKAANNKPVLSEDPPVISEPALVNSHNDGNAENCKLPNGVAVEAMGQGVENQNIVGSKAPTSPEKLSEELAAVKAQAAFRGYLARRAFRALKGIIRLQALIRGHLVRRQAASTLRVTWLIVKLQALVRGRNVRLSGASIQFVVKSGQHKFLSDKPSDAWKEKVSSNAYVRKLLSSSIGLEALHLQYDKRDPNSLYNWLERWTISQIWKSSSQPKKVADGKPQVRKASYAMETESAKLKRNVRKSSAVTVDSFQTNMTVEPEKIKRNSRKFSSSAADSVPDSQLSELEKVKRNLRKVTNSMAEASKISSSRADASKVSSSMADASKVSSSTADASKVSDSVAQIPPSLVNGISDHQDNQCEEAQQNACVSFPPETQELHSGILLEDNSHMNLLEPDLISNPETPFTSILTWEKFNDSTADAQEVEVLPLQNIDNEDNFPENGVLGKKEKPRSKEEPLSNGNLKTSKRRSSFSTKSDYPENGAQNTPVPRRKPSYMAATESAKAKLRGQNSPRLDSDSPADMNGFTRRQSLPSSTNNRAIRAEWRRW

SEQ ID NO: 14 - protein, 582 aa, Oryza sativa subsp. indica
  misc_feature: Public GI ID no.125527495
  misc_feature: Score of 851.5 for HMM of FIGURE 5.
  misc_feature: Functional Homolog Of Ceres CLONE ID no. 1792354 at SEQ ID NO. 2
  misc_feature (98)..(118): Pfam Name: IQ Pfam Description: IQ calmodulin-binding motif
MGKSPAKWIKSVLLGKKSAKSNSTKAKDLAKAANNKPVLSEDPPVISEPALVNSHNDGNAENCKLPNGVAVEAMGQGVENQNIVGSKAPTSPEKLSEELAAVKAQAAFRGYLARRAFRALKGIIRLQALIRGHLVRRQAASTLRVTWLIVKLQALVRGRNVRLSGASIQFVVKSGQHKFLSDKPSDAWKEKVSSNAYVRKLLSSSIGLEALHLQYDKRDPNSLYNWLERWTISQIWKSSSQPKKVADGKPQVRKASYAMETESAKLKRNVRKSSAVTVDSFQTNMTVEPEKIKRNSRKFSSSAADSVPDSQLSELEKVKRNLRKVTNSMAEASKISSSRADASKVSSSMADASKVSSSTADASKVSDSVAQIPPSLVNGISDHQDNQCEEAQQNACVSFPPETQELHSGILLEDNSHMNLLEPDLISNPETPFTSILTWEKFNDSTADAQEVEVLPLQNIDNEDNFPENGVLGKKEKPRSKEEPLSNGNLKTSKRRSSFSTKSDYPENGAQNTPVPRRKPSYMAATESAKAKLRGQNSPRLDSDSPADMNGFTRRQSLPSSTNSKLNPHSPHTQGPIYFKFD

SEQ ID NO: 15 - protein, 580 aa, Oryza sativa subsp. indica
  misc_feature: Public GI ID no.125553119
  misc_feature: Score of 656.4 for HMM of FIGURE 5.
  misc_feature: Functional Homolog Of Ceres CLONE ID no. 1792354 at SEQ ID NO. 2
MGKSPAKWIKSVLFGKKSSRSGSTKAKDLSKGSNNKGYAAAGKDAGFESSPVISEPVLVTPHNNEAVQEVGRGENSSLQGEVVVRDVSQDLEKQNTVVSDASNDPERLREEQAAVKAQAAFRGYLHGIGPGTSGIPCVERNHKTPSPDSWASRKEASRCNSSCNMVDCEVSSSSPWLTRPHTRNMCPNLLALKPHKQPIMLYKSYKSGKRDAWKEKLSSNAFARKLLASPILVEALHFQYDERDPNSAFNWLERWTIGRVWRPISHPKRAAVTDAKPHTRKASYAMETESGKLKRNSRRSSAAPVESSQTNMAMETEKSRRNPRKFTSSTADSVPESQLTELEKVKRNLRKVTNSMAEASKVSTPATEIPERQEVQCEKPQRTAEEVPNYPEIQEPQNGNLLENAKTDILVPDLQPEPEVPSYQVETEEKVAELTVADPAVETMPLQDIHNEENALVNDMEQRSKEEPLSTESLKSSKRRSSFSTKTEYPENGSKNSPAVPSYMAATQSAKAKLRGQNLPRLSSDSAEKNGFTRRHSLPSSNGKLNSHSPRTQRPTHAGGKEGVKADKSMLSSRDASGKL

SEQ ID NO: 16 - DNA, 2368 bp, Zea mays
  misc_feature: Ceres CLONE ID no.236431
  misc_feature: Encodes the peptide sequence at SEQ ID NO 17
agctgatttattttctctcgctctcgccttcgcggcgctgcctgcgcagtactacgagctagcaggctagcagcaccaggaccaggagcctcttcccacacttccgctcttcctctctctctttcctctcgagaatggttgtgtaggcgggcgcaggagggaggagagagaggggagctagctagggttttgcgtcgccgccttctgttacccttaggctctgaacccctccggtccagtgcggcggcggattaggctccgatggggaagtctccggcgaagtggatcaagtccgtgctcttcggtaaaaagtcgtcgtcgaggtccggctccaccaaggccaaggatttatcgaagggtaccactaacaaagcggcggctgctgctgctgccgggaaggagcctgcgttctctgagagctctccggtcatctcggagcctgtgcttgttagcgcccacaacaatgagaccgcgcgggaggccgctaagggtgagaattccagcgtgcaagaagtgccagtgactgatgttagtcaagacttggagaagcagggcactgttgggtctgatacgtctaatgatgctgagaggttgagggaagagcaagcggccgtgaaggcacaagctgccttccgtggttatctggcacgccgagcattccgtgccctgaaagggatcataagactacaggcactgattcggggacatcttgtaaggaggcaagctgtttcaactctccgtgctacatggttgattgtgaagtttcaagcccttgtccgtggaaggaacgttagactttctaaagtttccattcaaccaactacggaactttcccaacagaacttcgggggttctaaacctggttcctggaaggagaagttgtcttcaaatgcatttgctcggaagcttctctcttcaccaattgtggttgaggctcttcatgtccagtatgatgagatggaccctaattcggccttcaattggttagagaggtggacagtaagtcatgtctggaagcctatttcccaaccaaagagagttggtgctgatactaagcctcatacaaggaaggccagttatgcaatggaaacagagtcagcgaaattaaagcgtaatgcacggaagagccctgcagtgccatttgagccttctcaaacaaacaccaccattgaaaatgagaagacaagacggaatccaaggaaattaagtagcactcctgctgagtcagttcccgatggccagttaacagaacttgagaaggttaaacgtagccttaggaaggttactagttccatggttgaaacctcaaaggtgcctagcccaacaactgagattcctgaccgtcaagaggtacaatgtgagagaccactaagaagtgcaaagcaagctccaattcatgttgagaatcaagaacctcagaatgttaatctatcggacaatgcaaagatggatattctggtaccagatatccagcctgacgtggaagttgcttcagatctagtcacaatcacaaatgaagaaaaagttgatgagacaccgtctgttgttgctccagcgactgaaattatgccactgcaagacatcaacagcgaagaaaatgctttggtgaatgatgtggaagagagatccaaagaagaacatccatctactgataacctgaaaggcagcaagaggaggtcttcattctcagttaagcctgaatatccagaaaatggctccaaaaattctccagctctgccaagctacatggctgctacacaatctgcaaaggcgaaactgcgggggaattgttcaccaagacttagctctgattcagcagagaaaaacgggttcactcgtcgtcactcccttccgtcccctaacaatggtaagataatttcacattctccacgtacgcaaaggccaacccatgctggtggcaaggacggagcaaaaggcgacaaggctatgctgtcatcaagagatgcgagcgagagaccactgaaagctgagtggagacgctgaggtggcgaatcaaaaccccaaaccctccatttggttagtgcaactatttgggttggtggatggcgtctgcagtttgctccgattgttttgcttgtgatgtaaaaaagacgttatcatcatcatccgaggcgatgaacgggttcagctttgttgtgatgaatctgctgggagtcaacttatttacagggttttgggtcatgccttttgtgatgtatagctgaagtattttcccggtttgtttttgtttcccagacccccagactcccccctccccctcctgcttgctgagagggctgctgatgttagagagaacgagaacctgtatggattgagttgaacagaacaatcttagtcccgtttggtc

SEQ ID NO: 17 - protein, 580 aa, Zea mays
  misc_feature: Ceres CLONE ID no.236431
  misc_feature: Score of 1099.7 for HMM of FIGURE 5.
  misc_feature: Functional Homolog Of Ceres CLONE ID no. 1792354 at SEQ ID NO. 2
  misc_feature (114)..(134): Pfam Name: IQ Pfam Description: IQ calmodulin-binding motif
MGKSPAKWIKSVLFGKKSSSRSGSTKAKDLSKGTTNKAAAAAAAGKEPAFSESSPVISEPVLVSAHNNETAREAAKGENSSVQEVPVTDVSQDLEKQGTVGSDTSNDAERLREEQAAVKAQAAFRGYLARRAFRALKGIIRLQALIRGHLVRRQAVSTLRATWLIVKFQALVRGRNVRLSKVSIQPTTELSQQNFGGSKPGSWKEKLSSNAFARKLLSSPIVVEALHVQYDEMDPNSAFNWLERWTVSHVWKPISQPKRVGADTKPHTRKASYAMETESAKLKRNARKSPAVPFEPSQTNTTIENEKTRRNPRKLSSTPAESVPDGQLTELEKVKRSLRKVTSSMVETSKVPSPTTEIPDRQEVQCERPLRSAKQAPIHVENQEPQNVNLSDNAKMDILVPDIQPDVEVASDLVTITNEEKVDETPSVVAPATEIMPLQDINSEENALVNDVEERSKEEHPSTDNLKGSKRRSSFSVKPEYPENGSKNSPALPSYMAATQSAKAKLRGNCSPRLSSDSAEKNGFTRRHSLPSPNNGKIISHSPRTQRPTHAGGKDGAKGDKAMLSSRDASERPLKAEWRR

SEQ ID NO: 18 - DNA, 2129 bp, Triticum aestivum
  misc_feature: Ceres CLONE ID no.908518
  misc_feature: Encodes the peptide sequence at SEQ ID NO 19
agaacctctctctctcctctgctccacgccacagaagagaacaaacagtaggaggagcgctctccttcggccgcgagcgtctgcgtcccgcaatggaggcgtgatggttggcgcggatagaggggtagcgggacagggaaggtgagcaatctgccgggagagcgccgacgccccgcccagtccagcccaggtccagaatttccggtgtttgagcagttttagtaggctgctatggggaagtccccggccaagtggataaagtccgtgctcctcgggaagaaatcaacaaaatccaattctaccaaggcaaaggatcttccagcaaaggctgcaaacagcaacggatgcactgctgggaaggagcctgaatcctctgataattctcccctcatctcggagccggtacttgttagctcccacaatgtgtctgaaatttccaacttgcccaatgggagggcaatcgaaaacatggttagagttgggtccgacacgcaaattagtccagagaaactgagagaagaactagcagcagtgaaggcgcaagccgcttttcgaggttacctggcacgcagggccttccgcgcattaaaaggtatcatcagacttcaggcactgattcgagggcatcttgtaaggaggcaggccgtttcaacccttcgtggaacatggttgattgtgaagtttcaagctctagttcgtggaagaaatgttagattttctagtgctgccacgcaattagctgtgaagtttggtcaacataagtatgggggtgacaagtcgtcggatgcatggaaggagaagctatcttcacatccatatgttcgaaagcttctgtcttcaccaattttggtacaagctcttcacgttcagtatgatgagacaaaccccaattcagccctcaactggctggagagatggacaataagctgcatctggaagcctgtttccaaaccaaaaatagttactgacgggaaaccacaagtaaggagggccagttatgccatggaaactcactcagcaaagttaaagcgcaatgttcggaagtcttctactgccactgttgagactcaggcaaataccgttgaatctgaaaaatggaaaagaaacccacggaaattgaatggctcacctgctgattcagtaccagacagccagttatctgaacttgagaaggttaaaaggaaccttaagaaggcagctaactccatggctgaagcctctaagatatctaccaaggctgatgtgttgaaggtacctaattccatagctgatgagctgaagatacttggttccatggctgaactatcaaaaaaatccagcataccaaacggtatctctgaccatcaagacagcgaatgcgagaaagcactagagagtacacgtgaggctgtgtttcctcttggaactcaagattctcacagtggcaatcttttggaaaattcaaatataagtaagttggtacctgacataaaatatgatctagaagcatcattcttaggggacaaagttaatgaacccactactgtcgctcaagcagatgaagtcatacaactgcagaaccttgataacggatatgatattatagaaaggaaagaagagactaggtccaaggaagaacctctgcctaatggaagccttaaaaccaagagaaggtcttcgttctctaattcagaataccctgagagtggaaccaagaacactccagttccatcaaggaagccaagctatatggctccaacagaatcgttaaaggcgaaattgcgaggaccacccagattagactctgatctaccagtggacaagaatgccttcactcgccgtcagtctcttccttctgctgcaaacaatagagcaatcaaaacagaatggaggcggtgaagaggctatcaagcttccaacagaagggtgcattattgtggaagaaatttcaagctgtataaattattgattagtttatgaagtttgctgatgtctacctgtctctgtccttgttgttctgtctacgttataaacatatgttcttacgcccttttcgaactagcttgtggtgatatgtttggtgctattttttcctcgagttatcttatagttccttggtccgtgtattaaatgtaaaaaaaaaaaaaaaa

SEQ ID NO: 19 - protein, 548 aa, Triticum aestivum
  misc_feature: Ceres CLONE ID no.908518
  misc_feature: Score of 1274.3 for HMM of FIGURE 5.
  misc_feature: Functional Homolog Of Ceres CLONE ID no. 1792354 at SEQ ID NO. 2
  misc_feature (97)..(117): Pfam Name: IQ Pfam Description: IQ calmodulin-binding motif
MGKSPAKWIKSVLLGKKSTKSNSTKAKDLPAKAANSNGCTAGKEPESSDNSPLISEPVLVSSHNVSEISNLPNGRAIENMVRVGSDTQISPEKLREELAAVKAQAAFRGYLARRAFRALKGIIRLQALIRGHLVRRQAVSTLRGTWLIVKFQALVRGRNVRFSSAATQLAVKFGQHKYGGDKSSDAWKEKLSSHPYVRKLLSSPILVQALHVQYDETNPNSALNWLERWTISCIWKPVSKPKIVTDGKPQVRRASYAMETHSAKLKRNVRKSSTATVETQANTVESEKWKRNPRKLNGSPADSVPDSQLSELEKVKRNLKKAANSMAEASKISTKADVLKVPNSIADELKILGSMAELSKKSSIPNGISDHQDSECEKALESTREAVFPLGTQDSHSGNLLENSNISKLVPDIKYDLEASFLGDKVNEPTTVAQADEVIQLQNLDNGYDIIERKEETRSKEEPLPNGSLKTKRRSSFSNSEYPESGTKNTPVPSRKPSYMAPTESLKAKLRGPPRLDSDLPVDKNAFTRRQSLPSAANNRAIKTEWRR

SEQ ID NO: 20 - protein, 574 aa, Oryza sativa subsp. japonica
  misc_feature: Public GI ID no.115465121
  misc_feature: Score of 966.7 for HMM of FIGURE 5.
  misc_feature: Functional Homolog Of Ceres CLONE ID no. 1792354 at SEQ ID NO. 2
  misc_feature (111)..(131): Pfam Name: IQ Pfam Description: IQ calmodulin-binding motif
MGKSPAKWIKSVLFGKKSSRSGSTKAKDLSKGSNNKGYAAAGKDAGFESSPVISEPVLVTPHNNEAVQEVGRGENSSLQGEVVVRDVSQDLEKQNTVVSDASNDPERLREEQAAVKAQAAFRGYLARRAFRALKGIIRLQALIRGHLVRRQAVATLRATWLIVKFQALVRGRNVRLSTNTIQVNWKLVQQQSGSGKRDAWKEKLSSNAFARKLLASPILVEALHFQYDERDPNSAFNWLERWTIGRVWRPISHPKRAAVTDAKPHTRKASYAMETESGKLKRNSRRSSAAPVESSQTNIAMETEKSRRNPRKFTSSTADSVPESQLTELEKVKRNLRKVTNSMAEASKVSTPATEIPERQEVQCEKPQRTAEEVPNYPEIQEPQNGNLLENAKTDILVPDLQPEPEVPSYQVETEEKVAELTVADPTVETMPLQDIHNEENALVNDMEQRSKEEPLSTESLKSSKRRSSFSTKTEYPENGSKNSPAVPSYMAATQSAKAKLRGQNSPRLSSDSAEKNGFTRRHSLPSSNGKLNSHSPRTQRPTHAGGKEGVKADKSMLSSRDASERPAKAEWKR

SEQ ID NO: 21 - DNA, 2529 bp, Panicum virgatum
  misc_feature: Ceres CLONE ID no.1791910
  misc_feature: Encodes the peptide sequence at SEQ ID NO 22
ggattggaggttggaggcctgaagggggaggtgggtcgccggacagggacggggagacggcgagagggcgttccgcaggagccgttcccgtgcttcctccaccgaccgggccgacgcgccgcgccgctgtttcaggttcccgcccctgcatttttctgcttgtgcttgcgctagttgcgagggtaggttgcggcgttagagattggttcgcggcttctgtgcggcgctgtgtttgtttggccagatccgcgtgtgtgctgctgactcttcgtgatttcctcttctgtttgagctttccttgctcggctttgtgctgctgcctgcctgctgcttctttttctggccactgcatttgggttgtgtgccgcgctacttatcctgctctgcttgtgtttaagattacagctcgtgtttctttcaacgatattttcacctttgtttcatcacttgggaagctggtgccgtaaaagagtctgctaaaccatgctaactttagcgaaattactgttactccagctgtccagcatgttccttccttcatcttagtgaaaataaagtatgttgtggcatactggtatggatctgtgcattgctgagctcctctgtttacaggttccagaatttcaagtattggccgctttaggatactatgggaaagtccccggggaagtggatcaagtctgtgctcttggggaagaaatcgactaaatccggttctaccaaggcaaatgagtcggctacaaataacaatggacactcagctggggaggagcgtgcattttctgaaaattctccagtgatctctgagccggtgcttgttgaagcccacaaaaatggagctgtttcagttaatgggaaggctgaagatgtcaatttgccaagtgacagggctggccaacaagatctgcagaaccaaagtattgttgagtccgaaacatcagttcctgggcaattgggagaagaccaagctgcagtgaaggcacaggcagcatttcgcggttacctagcacgaaggtcattccgtgcattgaaaggtatcataagactccaggcactgattcgagggcatcttgtaaggagacaggctgtttcaacccttcaaactacttggttgattgtgaagtttcaatctctagttcgtggaagaaatgtcagactctctggtgctgacattcaactcaatgtgaagcttggccaacataaccttggtggcactagatcatctgatgcatggaaagagaagttatcttcaaatgcctatgttcggaagcttctgtcttcaccaatagtgctagaacctcttcacttccagtatgacaagagggatcccaattcaacctataactggctagagagatgcaccataggctgcatctggaagcctgtttttcaaccaaaaagagttcctgatgggaaactgctggtaaggaaggctagttatgcaatggaaactgaatcagccaagttaaagcgcaacattaggaagggctctgctgctacagttgagagtttccatacaagagtgactggtgaatctgagaaacttaaacgtaatccaaagaaattctcaaacttccctgctgactcagtaccagatagccagttatctgaacttgagaaggttaaaaggaacctgaggaaggtaactgattccatggctgaagcctcaaagatctctagttccagggttgattcctcaaaggtatctgattctacacctgatgctccaaaagtatctaatcctgtggccgaaatctcaaagacatctagtctcctgaacgggatctctgaccatcaagacagccaatgtgaaaaagcactacagaatacacgtgaggcttcatttcctcttgaaactcaagattactctggcaatggtcagctattggaatattcagatatggataacttcgacttggtacctggtttgaaaagtgatctggaaactcagcttgattcagtttctataggagaaaatgttgatgagcccactgttggtgcttcagcagctgaaggtatgccactgcagaacattgataagcccaatagtttagggaagaaagaggaagcaaggtccaaggaagagcatctgtctaatggaagccttagaactggcaagagaaagtcttcatccccatacaaatcagaatatgtggaaaacgggactcacactactcctgctcagccaaggaagccaagctatatggctgcaacggagtctgcgaaggcgaaattacgagcacagaattcacccagggtggattctgattcatcagcagaaaagaatggcttcactcgacgccactctcttccttccggtacaaacagtagggcgatcaaagctgaatggaagcgctgaggaggcattggcttgaattgaatagtgcgattgtctgaatctctgctgggtgaactctgccgctgcttgctcctttttatttatcctgcgatgtaaagagaagacgttgtccctgtattgaacaatctttgtgatgagtgcgtctggttcaaaaaaaaaaaaaaaaaaaa

SEQ ID NO: 22 - protein, 569 aa, Panicum virgatum
  misc_feature: Ceres CLONE ID no.1791910
  misc_feature: Score of 824.9 for HMM of FIGURE 5.
  misc_feature: Functional Homolog Of Ceres CLONE ID no. 1792354 at SEQ ID NO. 2
  misc_feature (105)..(125): Pfam Name: IQ Pfam Description: IQ calmodulin-binding motif
MGKSPGKWIKSVLLGKKSTKSGSTKANESATNNNGHSAGEERAFSENSPVISEPVLVEAHKNGAVSVNGKAEDVNLPSDRAGQQDLQNQSIVESETSVPGQLGEDQAAVKAQAAFRGYLARRSFRALKGIIRLQALIRGHLVRRQAVSTLQTTWLIVKFQSLVRGRNVRLSGADIQLNVKLGQHNLGGTRSSDAWKEKLSSNAYVRKLLSSPIVLEPLHFQYDKRDPNSTYNWLERCTIGCIWKPVFQPKRVPDGKLLVRKASYAMETESAKLKRNIRKGSAATVESFHTRVTGESEKLKRNPKKFSNFPADSVPDSQLSELEKVKRNLRKVTDSMAEASKISSSRVDSSKVSDSTPDAPKVSNPVAEISKTSSLLNGISDHQDSQCEKALQNTREASFPLETQDYSGNGQLLEYSDMDNFDLVPGLKSDLETQLDSVSIGENVDEPTVGASAAEGMPLQNIDKPNSLGKKEEARSKEEHLSNGSLRTGKRKSSSPYKSEYVENGTHTTPAQPRKPSYMAATESAKAKLRAQNSPRVDSDSSAEKNGFTRRHSLPSGTNSRAIKAEWKR

SEQ ID NO: 23 - protein, 567 aa, Oryza sativa subsp. japonica
  misc_feature: Public GI ID no.125595019
  misc_feature: Score of 928.2 for HMM of FIGURE 5.
  misc_feature: Functional Homolog Of Ceres CLONE ID no. 1792354 at SEQ ID NO. 2
  misc_feature (111)..(131): Pfam Name: IQ Pfam Description: IQ calmodulin-binding motif
MGKSPAKWIKSVLFGKKSSRSGSTKAKDLSKGSNNKGYAAAGKDAGFESSPVISEPVLVTPHNNEAVQEVGRGENSSLQGEVVVRDVSQDLEKQNTVVSDASNDPERLREEQAAVKAQAAFRGYLARRAFRALKGIIRLQALIRGHLVRRQAVATLRATWLIVKFQALVRGRNVRLSTNTIQVNWKLVQQQSGSGKRDAWKEKLSSNAFARKLLASPILVEALHFQYDERDPNSAFNWLERWTIGRVWRPISHPKRAAVTDAKPHTRKASYAMETESGKLKRNSRRSSAAPVESSQTNIAMETEKSRRNPRKFTSSTADSVPESQLTELEKVKRNLRKVTNSMAEASKVSTPATEIPERQEVQCEKPQRTAEEVPNYPEIQEPQNGNLLENAKTDILVPDLQPEPEVPSYQVETEEKVAELTVADPTVETMPLQDIHNEENALVNDMEQRSKEEPLSTESLKSSKRRSSFSTKTEYPENGSKNSPAVPSYMAATQSAKAKLRGQNSPRLSSDSAEKNGFTRRHSLPSSNGKLNSHSPRTQRPTHAGGKEGVKADKSMLSSRDASGKL

SEQ ID NO: 24 - protein, 636 aa, Arabidopsis thaliana
  misc_feature: Public GI ID no.42568886
  misc_feature: Score of 1517.7 for HMM of FIGURE 5.
  misc_feature: Functional Homolog Of Ceres CLONE ID no. 1792354 at SEQ ID NO. 2
  misc_feature (129)..(149): Pfam Name: IQ Pfam Description: IQ calmodulin-binding motif
MGKTPSPGKWIKSLLGKKSSKSSLEKGGEKLRSAKKEELVVKVKDNNVSKLPTEPPVVSSQEVAATQTVVVPDVVIAEKQLSGDIEGDESSNVNLESGNDSEEVKLEEAATKVQAALRAQQAREESQNLKGITRVQAVIRGHLVRRQAVATYSCIWGIVKVQALVRGKKARSSETVAQLQKTNTETETSETLQGSTYSWMENPTKLSMIDKLLVSSPTTLPLKIQYSPEDPNSAKVWLGRWTQLQVWAPGPLVVKNLVPKSQTKKRSFQAVEAEKGKLKRGVRKPTGVSTTANSSTSRSTADNEKPKRTVRKASTLGKELSKIENDKSKQSSRKSTSAIKEGSSVEVKDEKPRISHKKASLSNGIGKATRKSAEKKKEIADAVQKELPIEEVSVSLVDAPEDEKMNLIPVTISKESDLDKDEKSLVLDKPEQDELRTAERDDKAEEELKTAERDDSAEEKIQEPDAQISSENGNVASENTKPSDRRASLPAKIENHHQDDGLTQSGRKIPSYMAPTASAKARIRGQGSPRIAQEKPEKNGTTRRHSLPPAANGKLSTMSPRAHRLLIASAKGSMNSDRSFSSSKDIGGKRFKPITIHKPFCQFLLHYLHPFNKFSSCLYQTSRRKLSGNGESTKAE

SEQ ID NO: 25 - protein, 650 aa, Arabidopsis thaliana
  misc_feature: Public GI ID no.2947062
  misc_feature: Score of 1502.4 for HMM of FIGURE 5.
  misc_feature: Functional Homolog Of Ceres CLONE ID no. 1792354 at SEQ ID NO. 2
  misc_feature (143)..(163): Pfam Name: IQ Pfam Description: IQ calmodulin-binding motif
MGKTPSPGKWIKSLLGKKSSKSSLEKGGEKLVRRVNRSAKKEELVVKVKDNNVSKLPTEPPVVSSQEVAATQTVVVPDVVIAEKQLSGDIEGDESSNVNLESGNDSEEVKLEEAATKVQAALRAQQVNVYIFDILAREESQNLKGITRVQAVIRGHLVRRQAVATYSCIWGIVKVQALVRGKKARSSETVAQLQKTNTETETSETLQGSTYSWMENPTKLSMIDKLLVSSPTTLPLKIQYSPEDPNSAKVWLGRWTQLQVWAPGPLVVKNLVPKSQTKKRSFQAVEAEKGKLKRGVRKPTGVSTTANSSTSRSTADNEKPKRTVRKASTLGKELSKIENDKSKQSSRKSTSAIKEGSSVEVKDEKPRISHKKASLSNGIGKATRKSAEKKKEIADAVQKELPIEEVSVSLVDAPEDEKMNLIPVTISKESDLDKDEKSLVLDKPEQDELRTAERDDKAEEELKTAERDDSAEEKIQEPDAQISSENGNVASENTKPSDRRASLPAKIENHHQDDGLTQSGRKIPSYMAPTASAKARIRGQGSPRIAQEKPEKNGTTRRHSLPPAANGKLSTMSPRAHRLLIASAKGSMNSDRSFSSSKDIGGKRFKPITIHKPFCQFLLHYLHPFNKFSSCLYQTSRRKLSGNGESTKAE

SEQ ID NO: 26 - DNA, 1881 bp, Populus balsamifera subsp. trichocarpa
  misc_feature: Ceres ANNOT ID no.1468228
  misc_feature: Encodes the peptide sequence at SEQ ID NO 27
atggggagaaaatcacctgcgaaatggataaagactgttttgtttggaaagaagtcttccaaatctcttattgtcaaaggaagggagagaactgtgaatgacaaagagacattggttgctgtcagagccgtggaagctgatgtgacctcagttcctccggtggtcaagccgacagcccccactaccactaatatcactgaaaggatgttagagctagagagcagggaaactacagaatcatcacgtgatggaggtatattgtcaactggaaatcaagatgcaaatcattctcaattatacactcctgatgctcctccatctgatgctgacaaaataaggcttgatgaagctgcgacaatggcacaagccgcatttaggggttacttgataggtgcactactggggctgttttcatggaccttgagggttcgactgacttggtaccaggctcgccgagcatttcgagctcttaaaggcataataaggcttcaggctcttatccgtggacacttggttagaaggcaagctgttgctactctctgctgtgtgctcggagttgtcaagttacaggctcttgctcgaggaagaatggttaggaattcagagattggctatgaggttcataaattatgcagccaagtaaaactgccggagggcaagcttgcagattctagtggagttggtatacaaatggccaagctgtcatcaaatgcttttgttcgcaagcttcttgctccatcacctgctgtaatgcctttgcaactcccctatgattccatggaaccaaactcagttgcaaactggttagagtgctggtcagcgtcctctttctggaaaccagttccccaaccaaaaaaaattacttgctcaaaaactcagagaaagcagagtaatggtcaaatagtggaagctgaaactggtaggccaaagcgcactgttcggagggtccctgctgcaaatgttgacagtacctcagtacaagcagcctctgaatttgagaaacccaagcgcaatttgaggaaagtttcaagccatccagctgattcagcagaaaattcacagattgagcttgaaaaggtaaagcgcagcttaagaaaggttaataaccccgttatagaaaactctgctcattcagaggttgaaaatgaaaagccaaagcaaggtctagaaaaggtatctggcacttcaggtgataatgttttgggatggagcgtaagtaattcagctgagaagatgaagaaagaagctaccttgacaacatccaatgtacctgatgtggtgaagaatgatccaaacttgatgtccaagttgcctgatgcagagacagctgatgaacctgtagaaatgatcaaggcattggaatcatcacatgacgatcaagctgtggtagaatctaaagcttcagtagatactggtggtatagttgagaatatgcaaataaatgggaagtccatacaccaggatgatccaacaagcaatgaaaatcacaaaactgccaagaaaccttcattcacaatgaaaccagaacgtgccgagaatgggctacagagcagtcccaccctccctagctacatggcagcaactgaatctgcaaaggcaaagctgagaatgcaaggctccccaagatttagtgaagatcgagttgagaaaaataacatcacccgtcgtcattctctgccctcttcaactaatagcaaaatcagctccgagtccccgaggacacaaagagcagttcatggtagtggcaaaggggggaataagagtgacaagtctttattgtcttcaagagatggaaatgctaagggagcccaaccagagtggaagagatcatggtgtagcagtgaaacatggtctatagccggaagggagtatgtggattaa

SEQ ID NO: 27 - protein, 626 aa, Populus balsamifera subsp. trichocarpa
  misc_feature: Ceres ANNOT ID no.1468228
  misc_feature: Score of 1490.5 for HMM of FIGURE 5.
  misc_feature: Functional Homolog Of Ceres CLONE ID no. 1792354 at SEQ ID NO. 2
  misc_feature (157)..(177): Pfam Name: IQ Pfam Description: IQ calmodulin-binding motif
MGRKSPAKWIKTVLFGKKSSKSLIVKGRERTVNDKETLVAVRAVEADVTSVPPVVKPTAPTTTNITERMLELESRETTESSRDGGILSTGNQDANHSQLYTPDAPPSDADKIRLDEAATMAQAAFRGYLIGALLGLFSWTLRVRLTWYQARRAFRALKGIIRLQALIRGHLVRRQAVATLCCVLGVVKLQALARGRMVRNSEIGYEVHKLCSQVKLPEGKLADSSGVGIQMAKLSSNAFVRKLLAPSPAVMPLQLPYDSMEPNSVANWLECWSASSFWKPVPQPKKITCSKTQRKQSNGQIVEAETGRPKRTVRRVPAANVDSTSVQAASEFEKPKRNLRKVSSHPADSAENSQIELEKVKRSLRKVNNPVIENSAHSEVENEKPKQGLEKVSGTSGDNVLGWSVSNSAEKMKKEATLTTSNVPDVVKNDPNLMSKLPDAETADEPVEMIKALESSHDDQAVVESKASVDTGGIVENMQINGKSIHQDDPTSNENHKTAKKPSFTMKPERAENGLQSSPTLPSYMAATESAKAKLRMQGSPRFSEDRVEKNNITRRHSLPSSTNSKISSESPRTQRAVHGSGKGGNKSDKSLLSSRDGNAKGAQPEWKRSWCSSETWSIAGREYVD

SEQ ID NO: 28 - DNA, 2050 bp, Gossypium hirsutum
  misc_feature: Ceres CLONE ID no.1942388
  misc_feature: Encodes the peptide sequence at SEQ ID NO 29
atttagttttaaattcactaaaaaaaagcctgcacgagattctcttgttcgaggaatccttcacgatctctgaatgctcacagttccggtaatggcagcttagtaccgaacaaggacttcatatttgatactcttttcagatttccagatttagaaacttgggattttaattatttttgggtttaactgagatggggaaatctccagcgaaatggatcaagaccttgcttcttgggaagaaatcttcaaagtccagtttctcaaaaggaaaagataagctgaattctgcaaataaaggtgaggttttggtttcttccaaggtaactgtgtctgacctatcagcggattctccatcgatttcagcacctattctagtgagccgtgctaggaatgtgatggactctgagaagggtatacctgcccaattgccgattgatggggaaaatattccatctctaaaagtggatggaaataatgccacaaccggtaattttggtaacccagaaaatcctgataggattaggcttgacccagctgctgtgacagtacaggctgctttcagaggttatctggctcgccgggaatttcgaatcctcaagggcattataaggctgcaggcagttattcgtggtcacttggttagaagacaagctgttgctactttatgctgtacatggggaattgttaagttgcaagcactagctcgtggtcaaaaggtcagatgttcagatattgccatggaaatacaggaaaaacatctaagactgcttcagggtttgaaaagctcaaattctgtaggagcgagcatatcttctacagtgaagaatttatcaagtaatgtgtttgttcagaagcttttggcctcgtcaccttctgtattgcctctacaacttcagtatgttccagaggagcctaactcatcctggcaatggcttcaacgatggacaagatcacaattttgggaatacccctcaaaaccaattaggagtggaaagacaaagctaagtgttcagaaactatcctttgcaaaagctgttaatggatctagtcattctacattggagtatgaaaaaaataaacgaggtctgaggagaatttctgtcaactcagcagcagattcagttcgggagcatccacaaaatgagctcgagagggttaagcgcaatttaagaaagctttccaactcttcaaaggaggttactgataagtctgagtttgttaatgagaaaacaaagaagactctgaaaaaatattctagttctaatggccctgatgttttagaacaggaatctgctgagaagataagagatgtgactgcaacactatcagaactgtcaattcttgaggcagatctgaaattttcctcagaacatgcttctcttggtgagcctattgtctgtcctgcagttgattttccaccggccaaaaacaatggtaaaattgagcacatgccactaacagaggagttaaactctaaggatgagcaggtcggtgatgagagctcaaacacaaaccaaagaagagcttctttcccagcaaatattgataatcaggcaaatcggttaaatcacatgccaaaagtgcccagttatatggcaccaactgaatctgcgaaagctagacttaggggtcaagggtccccaaggtttatccccgaggctgttgagaaaaatgggttaaacaggcggtattctttgccaacttcaaccaatagtaatacaggttcacaatccccacatactcaaagacaggttcgagtagctggcaaaggtgctatcatcagtgacaaatctcaatcatcctctaaagatgctaatgataaggtggtcagagccgagtggaggaggtaattcttgcacaaggaattgtttcgatgaagtttccatgggtaaatatttgtagatgttacagttgtttatttggttcgtttttgtttggacgtaaaattctttggatcccctgttcactcttttctaccatttaatatcataggaatagagtgtgcccatctccatatctggctttcgtagaaaaaaaaaaaaaaaaaaaa

SEQ ID NO: 29 - protein, 552 aa, Gossypium hirsutum
  misc_feature: Ceres CLONE ID no.1942388
  misc_feature: Score of 1315.8 for HMM of FIGURE 5.
  misc_feature: Functional Homolog Of Ceres CLONE ID no. 1792354 at SEQ ID NO. 2
  misc_feature (113)..(133): Pfam Name: IQ Pfam Description: IQ calmodulin-binding motif
MGKSPAKWIKTLLLGKKSSKSSFSKGKDKLNSANKGEVLVSSKVTVSDLSADSPSISAPILVSRARNVMDSEKGIPAQLPIDGENIPSLKVDGNNATTGNFGNPENPDRIRLDPAAVTVQAAFRGYLARREFRILKGIIRLQAVIRGHLVRRQAVATLCCTWGIVKLQALARGQKVRCSDIAMEIQEKHLRLLQGLKSSNSVGASISSTVKNLSSNVFVQKLLASSPSVLPLQLQYVPEEPNSSWQWLQRWTRSQFWEYPSKPIRSGKTKLSVQKLSFAKAVNGSSHSTLEYEKNKRGLRRISVNSAADSVREHPQNELERVKRNLRKLSNSSKEVTDKSEFVNEKTKKTLKKYSSSNGPDVLEQESAEKIRDVTATLSELSILEADLKFSSEHASLGEPIVCPAVDFPPAKNNGKIEHMPLTEELNSKDEQVGDESSNTNQRRASFPANIDNQANRLNHMPKVPSYMAPTESAKARLRGQGSPRFIPEAVEKNGLNRRYSLPTSTNSNTGSQSPHTQRQVRVAGKGAIISDKSQSSSKDANDKVVRAEWRR

SEQ ID NO: 30 - protein, 570 aa, Arabidopsis thaliana
  misc_feature: Public GI ID no.12324824
  misc_feature: Score of 428.7 for HMM of FIGURE 5.
  misc_feature: Functional Homolog Of Ceres CLONE ID no. 1792354 at SEQ ID NO. 2
  misc_feature (105)..(124): Pfam Name: IQ Pfam Description: IQ calmodulin-binding motif
MIVFFFFFFCSNYSYNNAQRVVSGKEVLVTSKVEESDVVSDLPSFEVAETNTVDRSGGMLETQNVGPEEISDDEIELPEGKSTDSQNVAPVQDHSLSDAERIQREIAATSVQAAFRGYLARRAFWALKGIIRLQALIRGHLVRRQAVATLFSVMGIVRLQAFARGREIRKSDIGVQVYRKCRLQLLQGNKLANPTDAYLGIKKLTANAFAQKLLASSPKVLPVHAYDTSNPNSNLIWLENWSASCFWKPVPQPKKTISRKPQNRLLVEAESAKPKKSVRKVPASNFESSSVQTSFEFEKPKRSFRKVSSQSIEPPAVEDPQIELEKVKRSLRKVHNPVVESSIQPQRSPRKEVEKPKLGVEKTRESSYPLVHETAEEPVNVCDEKKKQEISEQPEEEVHALEMEVHTPGPLETNEALDSSLVNQIDSNEKAMVEEKPSMEKDTKEEKTPKPNNKENSAGKENQKSRKKGSATSKTEREESNGHHETSPSIPSYMQATKSAKAKLRLQGSPKSAEQDGTEKATVPRRHSLPSPGNGRITSHSPRTTRLANSGDKTGNKKEKPLLSSREGNG

SEQ ID NO: 31 - protein, 570 aa, Arabidopsis thaliana
  misc_feature: Public GI ID no.5882749
  misc_feature: Score of 428.1 for HMM of FIGURE 5.
  misc_feature: Functional Homolog Of Ceres CLONE ID no. 1792354 at SEQ ID NO. 2
  misc_feature (105)..(124): Pfam Name: IQ Pfam Description: IQ calmodulin-binding motif
MEMLAYFLSEFQICYNNAQRVVSGKEVLVTSKVEESDVVSDLPSFEVAETNTVDRSGGMLETQNVGPEEISDDEIELPEGKSTDSQNVAPVQDHSLSDAERIQREIAATSVQAAFRGYLARRAFWALKGIIRLQALIRGHLVRRQAVATLFSVMGIVRLQAFARGREIRKSDIGVQVYRKCRLQLLQGNKLANPTDAYLGIKKLTANAFAQKLLASSPKVLPVHAYDTSNPNSNLIWLENWSASCFWKPVPQPKKTISRKPQNRLLVEAESAKPKKSVRKVPASNFESSSVQTSFEFEKPKRSFRKVSSQSIEPPAVEDPQIELEKVKRSLRKVHNPVVESSIQPQRSPRKEVEKPKLGVEKTRESSYPLVHETAEEPVNVCDEKKKQEISEQPEEEVHALEMEVHTPGPLETNEALDSSLVNQIDSNEKAMVEEKPSMEKDTKEEKTPKPNNKENSAGKENQKSRKKGSATSKTEREESNGHHETSPSIPSYMQATKSAKAKLRLQGSPKSAEQDGTEKATVPRRHSLPSPGNGRITSHSPRTTRLANSGDKTGNKKEKPLLSSREGNG

SEQ ID NO: 32 - DNA, 1461 bp, Zea mays
  misc_feature: Ceres CLONE ID no.325403
  misc_feature: Encodes the peptide sequence at SEQ ID NO 33
aaatgcatttgctcgcaagcttctatcttcatcaattgtggttgaggctcttcacttccagtatgatgagatggaccctaattcagccttcaattggttagagaggtggacgataagtcatgtctggaagcccacttcccagccaaggagagttagtgctgatgctaagccacatacaaggaaggccagctatgcaatggaaacagagtcagtgaaattaaagcgtaatgcacggaggagctctgcagtgccatttgaaccttctcaaacaaacactgccattgaaattgagaagacaagacggaatccaaggaaattaagtagcactcctgctgagtcagttcctgatggccagttaacagaacttgagaaggttaaacgtagccttaggaaggttactaattctgtggctgaaacctcgaaggcacctagtccaaaaactgagattcctaaccatcaagaggtccaatgtgagagaccactaagaagagcaaaacaggttccaattcatcttgagaatcaagagcctgataatgttaatctgttggacaatgcaaagatggatattctggtacctgatatccagcctgatgtggaagttgcttcagatccagtcaccatcactaatgaagaaaatgttgatgaaccaccatctgttgttgctccagtggccgaaattatgcccctgcaagacatcaacaacgatgaaaatgctttggtgaatgatgtggaagagagatccaaagaagaacatccttgtactgagagcctgaaaggcagcaagaggaggtcttcattctcagctaagcctgaatatccagaaaatggctccaaaaattctccagctctgccaagctacatggctgctacacaatcagcaaaggcgaaactgcggggaaatagctcaccaaaacttagctctgattcagcagagaaaaacggcttcactcgtcgtcactcccttccatcctctaacaacggtaagatggtttcacattctccacgtacacaaaggccagctaatgctggttgcaaggatggagcgaaaggtgacaaggctatgctgtcatcaagagatgcaagcgagagaccactgaaagctgagtggagacgttgaggcggcgaatcaaatccaaatcctccatttgattagcgtgaccgtttgggtggatggatcgcccttgcagtttgctcggatttgttttgtttgtgatgtaaaaaaatgatgtcgtcatcgtcggcgagatgaatgaaccggctttgttgtgatgaatccgctgggagtcaacttatttattatagggttttccgtcatgccttttgtgatgtatagctgaagtattttcccggtttgttttggttcccagacccccagacttcctcccttcttgttgagagctgctgatgttagagagaatgagaacatgcatggattgagttgaacaatcttacccatttggt

SEQ ID NO: 33 - protein, 371 aa, Zea mays
  misc_feature: Ceres CLONE ID no.325403
  misc_feature: Score of 576.4 for HMM of FIGURE 5.
  misc_feature: Functional Homolog Of Ceres CLONE ID no. 1792354 at SEQ ID NO. 2
NAFARKLLSSSIVVEALHFQYDEMDPNSAFNWLERWTISHVWKPTSQPRRVSADAKPHTRKASYAMETESVKLKRNARRSSAVPFEPSQTNTAIEIEKTRRNPRKLSSTPAESVPDGQLTELEKVKRSLRKVTNSVAETSKAPSPKTEIPNHQEVQCERPLRRAKQVPIHLENQEPDNVNLLDNAKMDILVPDIQPDVEVASDPVTITNEENVDEPPSVVAPVAEIMPLQDINNDENALVNDVEERSKEEHPCTESLKGSKRRSSFSAKPEYPENGSKNSPALPSYMAATQSAKAKLRGNSSPKLSSDSAEKNGFTRRHSLPSSNNGKMVSHSPRTQRPANAGCKDGAKGDKAMLSSRDASERPLKAEWRR

SEQ ID NO: 34 - DNA, 783 bp, Oryza sativa subsp. Japonica
  misc_feature: Ceres GI ID no.56784328
  misc_feature: Encodes the peptide sequence at SEQ ID NO. 35
atgcggggtttccccgttccggtgacgagttggagctccgccgcgctcctgggccgctccatctcctcggccagggacgcggccgaggcctcctcccccatcaccgccgcggagatggtccgggtggcgaaggaggtggccaacgccgccgacgcctgcggagtctccggcaagaagctgctggaggctgcggaagcgctgtccaggtccgacaccgacgcggagccgaggcggcgcgccgccgagcggattttcgatgcggcgtccatggtggccaaggaggccgacgcgtcaggagcgtcgggtctctcagatgcggcccaaaatctgacctgcgcgacctacgcgttctcggtagccgcctcgggatgggggtccttgccggagtccagcacgagcgggagggacgccggcgacctcctaaccgagccccttcttgggtcatgtcaggacaagaacgagaagatgaccggcgagggcaaggacttcagcgagatgaggaatagtgcagcggactctgatccacttcagcaatcggagattaaggagtcgtccctttttggaaaatgcaaagaactcctcaattatggttttcttggaggtcctgccctcctaccctatctaggctctggactgaggaaaacagtgtcaccctgcagcccgtctgtcttccactacatcttctcgtcgtggtggatttgcattgttgtcggatcacatgaacaaggagacttgaagatattacatatcgatagaatcacttctcatccaaatgataagtag

SEQ ID NO: 35 - protein, 260 aa, Oryza sativa subsp. Japonica
  misc_feature: Ceres GI ID no.56784328
  misc_feature: Score of 660.5 for HMM of FIGURE 6.
MRGFPVPVTSWSSAALLGRSISSARDAAEASSPITAAEMVRVAKEVANAADACGVSGKKLLEAAEALSRSDTDAEPRRRAAERIFDAASMVAKEADASGASGLSDAAQNLTCATYAFSVAASGWGSLPESSTSGRDAGDLLTEPLLGSCQDKNEKMTGEGKDFSEMRNSAADSDPLQQSEIKESSLFGKCKELLNYGFLGGPALLPYLGSGLRKTVSPCSPSVFHYIFSSWWICIVVGSHEQGDLKILHIDRITSHPNDK

SEQ ID NO: 36 - protein, 311 aa, Oryza sativa subsp. Japonica
  misc_feature: Public GI ID no.56784330
  misc_feature: Score of 826.7 for HMM of FIGURE 6.
  misc_feature: Functional Homolog Of Ceres GI ID no. 56784328 at SEQ ID NO. 35
MESRLLRSAALLARAARLARAAATSTGRAVTAEHLAEVVASAAGDRGFPSGALRQAALALARSSAPEARPRATAEVVRAAAMVFRAAQEAGSPGVAEVAGDLAHAAHDCVRALVESGPAAERPRCLLRLWRRKNRHNKNAAGEADLEAPLLHPHERPSSSSSPIGASLSEIIELSESERDFINYGMFGALAIFPYLTRTGGLKSAYSPLSPSTFHIIFCTWWICVGLDVLCGNRGRAMMKNILAFILAFYARASARLAILGVSLLVILYSHLELAPNEIYTLYILLGAATCMHLLVWAMDYMSRAPGDAAD

SEQ ID NO: 37 - protein, 311 aa, Oryza sativa subsp. indica
  misc_feature: Public GI ID no.125528718
  misc_feature: Score of 812.3 for HMM of FIGURE 6.
  misc_feature: Functional Homolog Of Ceres GI ID no. 56784328 at SEQ ID NO. 35
MESRLLRSAALLARAARLARAAATSTGRAVTAEHLAEVVASAAGDRGFPSGALRQAALALARSSAPEASPRAAAEVVHAAAMVFRAAQEAGSPGVAEVAGDLAHAAHDCVRALVESGPAAERPRCLLRLWRRKNRHNKNAAGEADLEAPLLHPHERPSSSSSPIGASLSDIIELSQSERDFINYGMFGALAIFPYLTRTGGLKSAYSPLSPSTFHIIFCTWWICVGLDVLCGNRGRAMMKNILAFILAFYARASARLAILGVSLLVILYSHLELAPNEIYTLYILLGAATCMHLLVWAMDYMSRAPGDAAD

SEQ ID NO: 38 - protein, 250 aa, Oryza sativa subsp. japonica
  misc_feature: Public GI ID no.125572975
  misc_feature: Score of 571.2 for HMM of FIGURE 6.
  misc_feature: Functional Homolog Of Ceres GI ID no. 56784328 at SEQ ID NO. 35
MRGFPVPVTSWSSAALLGRSISSARDAAEASSPITAAEMVRVAKEVANAADACGVSGKKLLEAAEALSRSDTDAEPRRRAAERIFDAASMVAKEADASGASGLSDAAQNLTCATYAFSVAASGWGSLPESSTSGRDAGDLLTEPLLGSCQDKNEKMTGEGKDFSEMRNSAADSDPLQQSEIKESSLFGKCKELLNYGFLGGPALLPYLGSGLRKTVSPCSPSVFHYIFSSWWICIVVVDELFVRIIDCSQ

SEQ ID NO: 39 - protein, 250 aa, Oryza sativa subsp. indica
  misc_feature: Public GI ID no.125528716
  misc_feature: Score of 567.3 for HMM of FIGURE 6.
  misc_feature: Functional Homolog Of Ceres GI ID no. 56784328 at SEQ ID NO. 35
MRGFPVPVTSWSSAALLGRAISSARDAAEASSPITAAEMVRVAKEVANAADACGVSDKKLLEAAEALSRSDTDAEPRRRAAERIFDAASMVAKEADASGASGLSDAAQNLTCATYAFSVAASGWGSLPESSTSGRDAGDLLTEPLLGSCQDKNEKMTGEGKDFSEMRNSAADSDPLQQSEIKESSLFGKCKELLNYGFLGGPALLPYLGSGLRKTVSPCSPSVFHYIFSSWWICIVVVDELFVRIIDCSQ

SEQ ID NO: 40 - DNA, 1443 bp, Arabidopsis thaliana
  misc_feature: Ceres SEEDLINE ID no.ME06748
  misc_feature: Encodes the peptide sequence at SEQ ID NO. 41
aattgtctcttcttttctttttgtacttgtcaaaaacaaaaagaacaacaaaaaaaatctcaaccgtagaaaattccgacaagagttcagttcatacaatgaactaagtatgggtttctttggaagactgttcggaagtaagaagcaagaaaaggcaacaccgaacagacgaagatggagcttcgctactagatcctcacatcccgagaatgattcgtcttctcatccaagcaagagacgtggggatgaagatgtcttaaacgccgacaagcatgcgatagccgtcgcggctgctacagctgcagtggctgaagccgcactcgctgctgctcgtgcggcggcggaagtcgtgagactcaccaatggtggtagaaactcgtcggtaaaacaaatcagtcggagtaatcgtcggtggtctcaagagtataaagcagctatccgcttttcgtggctacttggcgaggagggcgttgagagcactgaaggcattagtgaagcttcaagcgttggtgaagggacacatagtaaggaaacaaacggctgatatgctgcgtcgaatgcaaacgctggttcggctccaagcacgagctagagcttcgcgttcttctcacgtttctgactcttcccatccgccaacactaatgattccatcttccccacaatctttccatgcacgatgcgtttcagaggctgagtacagtaaagtcattgccatggatcaccaccacaacaaccaccgttcaccgatgggttcaagccggttattagaccaatggaggacagaggaaagtctatggagcgcaccaaagtacaatgaagatgatgacaaaatcctagaagtcgacacttggaagcctcacttcagagagtcaccaaggaaaagaggatctctagtggttcctacaagtgtggagaacagtccacaattaaggtctagaacaggaagcagcagtggtggttcaaggagaaaaactcccttcacgcctgcgagaagcgagtacgagtactactctgggtatcaccctaactacatggctaacactgagtcttacaaagcaaaagtccgatcacaaagcgcaccaagacagagactacaagatttaccttcagagagtggttacaagaggtctatacagggacagtattactactacacacctgctgcagagcgatcgtttgatcagcgttcggataacgggatcgcgggttacagaggagtttctgatgggttagatcgaaaccaaagtgacaaatcgaagatgtacacttcgtttttcagttctaatcctcttttctttcaatagtcgagaaaggatgaaaaaagtgagtggaatgtgtaaaattagatttcgacacacgagtacagagacagccagtgatcaatctgtgttttgtactattttctaattgactgtatccaacaagggtccattcttgtctgac

SEQ ID NO: 41 - protein, 252 aa, Arabidopsis thaliana
  misc_feature: Ceres SEEDLINE ID no.ME06748
  misc_feature: Score of 176.1 for HMM of FIGURE 2.
MLRRMQTLVRLQARARASRSSHVSDSSHPPTLMIPSSPQSFHARCVSEAEYSKVIAMDHHHNNHRSPMGSSRLLDQWRTEESLWSAPKYNEDDDKILEVDTWKPHFRESPRKRGSLVVPTSVENSPQLRSRTGSSSGGSRRKTPFTPARSEYEYYSGYHPNYMANTESYKAKVRSQSAPRQRLQDLPSESGYKRSIQGQYYYYTPAAERSFDQRSDNGIAGYRGVSDGLDRNQSDKSKMYTSFFSSNPLFFQ

SEQ ID NO: 42 - protein, 517 aa, Arabidopsis thaliana
  misc_feature: Ceres SEEDLINE ID no.ME20711
  misc_feature: Score of 943.4 for HMM of FIGURE 2.
  misc_feature: Functional Homolog Of Ceres SEEDLINE ID no. ME06748 at SEQ ID NO. 41
  misc_feature (169)..(189): Pfam Name: IQ Pfam Description: IQ calmodulin-binding motif
MGKKGSWFSAIKRVFTPHSKEKQLSNNNQEPEIKSENKEKKKKGFGKKLRNGETNSFLPIFRQPSSIEKILSEAEREHNLVFRPPTPTDRANSSSTSVASPLVRPASPKVPSQRYVSSPKPISPRVAYPQVHYPKPPSPKPPSPRAVSPRIVQRREFVHRPEPSLLVKNAYAIKIQAAFRGYMARRSFRALKGLVRLQGVVRGHSVKRQTMNAMKYMQLLVRVQTQVQSRRIQMLENRARNDKDDTKLVSSRMSDDWDDSVLTKEEKDVRLHRKIDAMIKRERSMAYAYSHQLWKNSPKSAQDIRTSGFPLWWNWVDRQKNQNQPFRLTPTRPSLSPQPQSSNQNHFRLNNSFDTSTPNSSKSTFVTPSRPIHTPQPYSSSVSRYSRGGGRATQDSPFKDDDSLTSCPPFSAPSYMAPTVSAKAKLRANSNPKERMDRTPVSTNEKRRSSFPLGSFKWNKGSLFMSNNSNNKGPGSSSSGAVVLEKHKTLKSVGNLSIDSTVSMPATIGRRAFNRFA

SEQ ID NO: 43 - protein, 383 aa, Arabidopsis thaliana
  misc_feature: Ceres SEEDLINE ID no.ME18973
  misc_feature: Score of 543.8 for HMM of FIGURE 2.
  misc_feature: Functional Homolog Of Ceres SEEDLINE ID no. ME06748 at SEQ ID NO. 41
  misc_feature (115)..(135): Pfam Name: IQ Pfam Description: IQ calmodulin-binding motif
MGRATRWFKGLFGIKPSSCSGTDSGTISNRLDRSLCDSYETIPPNISEKEAAWLRSFYAAGEEEKERRTHAIAVAAATAAAADAAVAAAKAAAAVVRLQGQGKSGPLGGGKSREHRAAMQIQCAFRGYLARKALRALRGVVKIQALVRGFLVRNQAAATLRSMEALVRAQKTVKIQRALRRNGNAAPARKSTERFSGSLENRNNGEETAKIVEVDTGTRPGTYRIRAPVLSGSDFLDNPFRRTLSSPLSGRVPPRLSMPKPEWEECSSKFPTAQSTPRFSGGSPARSVCCSGGGVEAEVDTEADANRFCFLSGEFNSGYMADTTSFRAKLRSHSAPRQRPESNASAGGWRRSIGGGGVRMQRQSCSGVREAVVGNIERRRMRW

SEQ ID NO: 44 - protein, 460 aa, Arabidopsis thaliana
  misc_feature: Ceres SEEDLINE ID no.ME08732
  misc_feature: Score of 822.2 for HMM of FIGURE 2.
  misc_feature: Functional Homolog Of Ceres SEEDLINE ID no. ME06748 at SEQ ID NO. 41
  misc_feature (128)..(148): Pfam Name: IQ Pfam Description: IQ calmodulin-binding motif
MAKKKSWFSLVKRLFIWDTHSTQDKKEKRRKWIFGRLKSKRLPSIKAPLPSKGTTLSEAEQEQSKHALTVAIASAAAAEAAVTAAHAAAEVVRLTGQRNENSEESQPVKTRNGAPQSTYQCQREIKESAAAIKIQTAFRGYLARKALRALKGIVKLQAIIRGRAVRRQAMSSLKCLQSIVSIQSQVCARRLQMVEGRCDYSENEEMQDFKDKIIRMDSNSERKWDESTVLKEEVDTSCTSKRERTKEYSFNHRRSAESERSKVNGRWRYWLEQWVDTQLSKSKELEDLDSVFSSHSRAGEEYGGRQLKLRSNIQRQNPVEGLDSPILGSRRSFPHRRQCSVGEDHSFLSSPATPAYMAATESAKAKARSTSSPKIRTGGNVDMNSDSYSPCKKKLSIASSINSEMLSNGRVGKLSVNQQQRSPSFKGLSVPIKSSRTTIKDLSINSDCSLPNWDRQAFFK

SEQ ID NO: 45 - protein, 403 aa, Arabidopsis thaliana
  misc_feature: Ceres SEEDLINE ID no.ME19657
  misc_feature: Score of 695.5 for HMM of FIGURE 2.
  misc_feature: Functional Homolog Of Ceres SEEDLINE ID no. ME06748 at SEQ ID NO. 41
  misc_feature (117)..(137): Pfam Name: IQ Pfam Description: IQ calmodulin-binding motif
MGFFGRLFGSKKKSDKAASSRDKRRWSFTTRSSNSSKRAPAVTSASVVEQNGLDADKHAIAVAAATAAVAEAALTAAHAAAEVVRLTSGNGGRNVGGGGNSSVFQIGRSNRRWAQENIAAMKIQSAFRGYLARRALRALKALVKLQALVRGHIVRKQTADMLRRMQTLVRLQSQARARASRSSHSSASFHSSTALLFPSSSSSPRSLHTRCVSNAEVSSLDHRGGSKRLDWQAEESENGDKILEVDTWKPHYHPKPLRSERNNESPRKRQQSLLGPRSTENSPQVGSSGSRRRTPFTPTSRSEYSWGCNNYYYSGYHPNYMANTESYKAKVRSQSAPKQRVEVSNETSGYKRSVQGQYYYYTAVEEESLDVGSAGYYGGGGGDSDRLNRNQSAKSRMHSSFLV

SEQ ID NO: 46 - DNA, 1711 bp, Triticum aestivum
  misc_feature: Ceres CLONE ID no.835818
  misc_feature: Encodes the peptide sequence at SEQ ID NO 47
ccaaatccaatgctctacatttcttccttctcgtgccctttcttgatttgcgcatggacagtgacttgcgttgccagcaaagagccatcctgctaggccctttgccaacatctccgtagatcacattccagagcagatagacagaagaatggagaggaagaagaaggggtggttcgagcgcatcaagaggctcttcatctccgaacccaagcagaaacccaaaccagacaagaaggtgaagagcaagagatggctggtagggaagctcaagacccagcactcgtttgccctgccagctccggagccggagccggcgacgggtcagattcagataaggcaggcggaggaggagcagagcaagcacgcagtggcggtcgcgctcgcctccgcagcggccgcagaggcagccgtcgcggccgcccacgcggccgcggaggtggtccgcctcacaggaccgccctcgccggcgccggcgccggcgcgtgaggacgccgcgtcttccggccacgaactgttcgccgccgtcgcgatccagtcagcctaccgcggatacctcgcgcggagggcactgcgcgcgctcaagggcctggtgaggctgcaggcggtgatccgcgggcaggcggtgcggcggaagacggcggcgacgctgcggggcctcgagtcgctggtcaagatccaggcccggcagcgcgccagggccgacgtcgaccacgagcacgacggcgacggcatggacgccctgctgaggagaggccgggagctgtacgccgccgcgctgcaagagcagcagcagagcagccggggggtgggacggcagcaccctctccaaggaagagatgggcgccgtgatgaggagcagggaggaagccgccatcaagcgcgtgcgcgcgctgcagtacgcctccatccagaacgagaagatcggcatcaggaggcagcccatgtccagggacgagatggagacgctcaaccagcgctggagctggctggaggagtgggtcggctcgcagcccttcgacaaggacgtggccgtcgacgtggtcacccacccccacccgccgccgcctcgctccagggactccctcgcctgcctcgaggacgacgacgaccatgatgacgacggctatggcaggcggctcggctactcgtccaggcggtccttcggccgcgccaggcgcacgccagggagggggagcgtcgacgacgggctgcaggcctgctcgccggcggtggctttcccggggtacatggcgtccacggcgtccgccaaggccaagttccggtccatgagcacgcccaaggagcgcttcgccgtgccatccgacgcatactcggagcagtgcttcgccgaccgcctcatgtcacccatcccgtccatgtcgccgatgccgtccatcgccagcgacatgggttttgctcgctccagcaggccgccggttgcgcagcggtcgccgcgtgtcaagggggggccgatgacgccgtcgaggatccgctccaggaggtcccccagccgccacagcttcggctctgaagccgcgctgcaccagatgcagatggagcactacacccctattcgctagacacaaacaaacttctttgtaatgtgaccaatgctgccttgtttggcgggcttgctctctctgggtctgaccatggaaaccttctcaaactgaccgtgctgtgcgaatgcaatatggatctgcaaactttc

SEQ ID NO: 47 - protein, 476 aa, Triticum aestivum
  misc_feature: Ceres CLONE ID no.835818
  misc_feature: Score of 855.1 for HMM of FIGURE 2.
  misc_feature: Functional Homolog Of Ceres SEEDLINE ID no. ME06748 at SEQ ID NO. 41
  misc_feature (122)..(142): Pfam Name: IQ Pfam Description: IQ calmodulin-binding motif
MERKKKGWFERIKRLFISEPKQKPKPDKKVKSKRWLVGKLKTQHSFALPAPEPEPATGQIQIRQAEEEQSKHAVAVALASAAAAEAAVAAAHAAAEVVRLTGPPSPAPAPAREDAASSGHELFAAVAIQSAYRGYLARRALRALKGLVRLQAVIRGQAVRRKTAATLRGLESLVKIQARQRARADVDHEHDGDGMDALLRRGRELYAAALQEQQQSSRGWDGSTLSKEEMGAVMRSREEAAIKRVRALQYASIQNEKIGIRRQPMSRDEMETLNQRWSWLEEWVGSQPFDKDVAVDVVTHPHPPPPRSRDSLACLEDDDDHDDDGYGRRLGYSSRRSFGRARRTPGRGSVDDGLQACSPAVAFPGYMASTASAKAKFRSMSTPKERFAVPSDAYSEQCFADRLMSPIPSMSPMPSIASDMGFARSSRPPVAQRSPRVKGGPMTPSRIRSRRSPSRHSFGSEAALHQMQMEHYTPIR

SEQ ID NO: 48 - DNA, 1651 bp, Panicum virgatum
  misc_feature: Ceres CLONE ID no.1796745
  misc_feature: Encodes the peptide sequence at SEQ ID NO 49
gtagcactagccactctcactccccccggcggcatggagaaggagaagaggcggaggagctggttcgagcgcatcaggcggctcttcacctcctccgagcccaaggagaaacccaaacctgacaagaaggcgaagagcaagcggtggctaccggggaagctgaggacgcagcagtcgttcgctctgccggcgccggcatccgcggccgcggacctgcagatcaggcaggcggaggacgagcagagcaagcacgccgtgaccgtcgctctcgccaccgcggcggccgccgaggccgcggtcgccgccgcgcacgccgccgccgaggtcgtccgcctcaccggccagcaggccgcggccccgccggccgggcgggagcgggagctggaggaggaggagcatgccgccgtcttgatccaatcggcgtaccgcgggtacctggctcggcgggcgctgcgcgcgctcaagggtctggtgcggctgcaggcgctgatccgggggcaggcggtgcggcaccagacggcggccacgctgcgcggcctcgagtccctgatgaggatccaggcccagcaccgctcccgggccggcggccccgaccacccggcggcgctcgacggcaacgacgacgccttcctgctccggcgcggccgggagctctacgccgccgcggtccaccagcagcagcaggcgggcagcaaagggtgggacagcagcatcctcgccaaggaggagatgcgcgccgtgatgcggagccgggaggaggccgccctcaagcgcgtgcgcgcgctgcagtacgcgtccctgcagagcgagcggctgggcgtccggcggccgccgctgcccagggacgaggaggcggacgcgctccaccgccgctggagctggctcgaggagtgggtcggcgcgcagccgcccttcgacaaggacgtccccgtggcgcaccagtcgccctacagcagggacgacgccgccgccgccaggggccgccagacgccgggccgggccgtcgacccgctcgccggcctcggcggcggcgacgccgaccggctcggttgctcggcgcggcggtccttcgtgcggccgaggcgcgcgccggcgcgggcgggcgactacttctacgaggacgccgcgccgtgctcgccggcgacgttcccggggtacatggcgtccacggcctccgccaaggccaagttccggtccatgagcacgcccaaggagcgcttcgccggagccgacgccttctccgagcactgcttcccgttcgccgaccgcatgctctcgccgatcccgtccatgtcgcccatcccctccatcgccagcgacatgggcttcgccaggtccaccaggccgcccgccgcgcagagatcgccgcgggtggcggccaagggccccatgacgccggcgcggtcgcgctcacggaggtcgccgagccaccacagcttcggctccgaggccgcgctgcaccaactgcagatggagcactacaccccagtccggtgaacaagactacagagagtgccttgcttcgttacactcttttgtgaagatacaattccctgctcccattcttttgtttgttcacctttcttgacagaagggttcaactgttcaagtattcagtaatggaatgcaacaacgtaaaaaaaaaaaaaaa

SEQ ID NO: 49 - protein, 487 aa, Panicum virgatum
  misc_feature: Ceres CLONE ID no.1796745
  misc_feature: Score of 472.4 for HMM of FIGURE 2.
  misc_feature: Functional Homolog Of Ceres SEEDLINE ID no. ME06748 at SEQ ID NO. 41
  misc_feature (121)..(141): Pfam Name: IQ Pfam Description: IQ calmodulin-binding motif
MEKEKRRRSWFERIRRLFTSSEPKEKPKPDKKAKSKRWLPGKLRTQQSFALPAPASAAADLQIRQAEDEQSKHAVTVALATAAAAEAAVAAAHAAAEVVRLTGQQAAAPPAGRERELEEEEHAAVLIQSAYRGYLARRALRALKGLVRLQALIRGQAVRHQTAATLRGLESLMRIQAQHRSRAGGPDHPAALDGNDDAFLLRRGRELYAAAVHQQQQAGSKGWDSSILAKEEMRAVMRSREEAALKRVRALQYASLQSERLGVRRPPLPRDEEADALHRRWSWLEEWVGAQPPFDKDVPVAHQSPYSRDDAAAARGRQTPGRAVDPLAGLGGGDADRLGCSARRSFVRPRRAPARAGDYFYEDAAPCSPATFPGYMASTASAKAKFRSMSTPKERFAGADAFSEHCFPFADRMLSPIPSMSPIPSIASDMGFARSTRPPAAQRSPRVAAKGPMTPARSRSRRSPSHHSFGSEAALHQLQMEHYTPVR

SEQ ID NO: 50 - protein, 501 aa, Oryza sativa subsp. indica
  misc_feature: Public GI ID no.125543896
  misc_feature: Score of 538.7 for HMM of FIGURE 2.
  misc_feature: Functional Homolog Of Ceres SEEDLINE ID no. ME06748 at SEQ ID NO. 41
  misc_feature (122)..(142): Pfam Name: IQ Pfam Description: IQ calmodulin-binding motif
MERKRRGWLERIKRLFVSEPKQKPKPDKKVKSKRWMFAGKLKTQHSFALPAPAPAVEEEQIRQAEDEQSKHAMAVALATAAAAEAAVAAAHAAAEVVRLTGKTAALAPAPATTTTPTPYGHEHAALMIQSVYRGYLARRALRALKGLVRLQALIRGQAVRRQTAATLRGLESLMKIQARQRARASSAAAAGGDHNAANSPAPDGMDALLRRGRELYYAAAAAVHEQQLSKGWDSSTLSKEEMSAMSRSREEAALKRVRALQYASLHQSEKVRVRRQPMSREEMETLNQRWSWLEEWVGSQPPFDKDIPVAHQSPSRDAAGAAMNDDERPPPPPVLRSRSRADRLACVGGDDDDADRQLGYSARRSFTRAGRRTPARDDDGGGAAAFPGYMASTASAKAKFRSMSTPKERSGAGAADAYSEQCFPFADRLLSPIPSMSPIPSIASDIVFARSSRPAAAQRSPRVKGPMTPTRSRSRRSPGRHSFSSEAALHQLQMEQYTPIR

SEQ ID NO: 51 - DNA, 1494 bp, Populus balsamifera subsp. trichocarpa
  misc_feature: Ceres ANNOT ID no.1483984
  misc_feature: Encodes the peptide sequence at SEQ ID NO 52
atgtcaggtctatcagagttgagaaatatgaaagttggaaaaaagatgggaggtcccatgagtcttgagaaggatgtttatatgagttgtggtgcttcaatggctaagaagagaagctggttctatcgagtgagaaggttatttacttctgacacacagtcaagacaagaaaaggaaaggagaagaaaatggatgttttttggaaagtttaaggtcaagaatagattggcctccattgcagctccatcatcaccactaagagaagaagcagagaaggagcagagcaagcatgctctaagtgttgctcttgccactgctgctgctgctgaggcagctgttgtagctgctcaggctgcggccgaggtggttttgctcactggtgttcctcattctatcaatgaatatgagaaagaaaccgaccatttagccttcgaagttcaaggtgatgcccctcattccactcatcaacatgcgagggggatcaaagaactggctgccatcaaaattcaagctacctttaggggttaccttgcaaggaaagctttgcgggcgctgaaggggatagtgaagcttcaagcaattatccgagggcggaacgtgagacgccaagccatgactactctaaaatgcttgcaatccattgtaaatatccagtcacaagtctgtgcaaaaaggatccaaatggtggaaggtgcttggacctgtagtgaaaataaacagttagaaaatttgagtgacaagataataaagatggatatgaatagtgaaagaagatgggatagcagccttctgacaaaggaagaggcagttgcctcgtttctaagcaagaaagaggccgcgattaagagagaacggataagagaatactggttcaaccgccggaattcagctgaatcggagcgaagcaagccaagtggaaggtggaggtactggttagatcaatgggtggatactcaacttgttaagagtaaagagcttgaagatttggactcagttttaacctcaaatccaaagcctggagtggaatatagaggaaagcagattaaactgagaggtttgcagagactgtatcaccttgacagtgtagattctcccatttcagctccaagaaaatccttccatagaaagcaatgctcgttgggagaagacaattccttttctagatctcctgtggttccaacttacatggcaacaactgaatctgccaaggcaaaaacaagatcaatgagctcaccaaagctaaggccagggagttttgatgcttactctgacagctattctccatgtaagaataagctttctctgatatcatctacaactactgaagtgccgagcagtgctaggtacggaaggcctagtgcttatcagcaaaggtctccaagcttgaagggccttccgggtccgataaaatgtaaccggccaacgtcgaaagttcttagctttgattcagattgctcattaaagacttgggataaacaaagttcctttagatga

SEQ ID NO: 52 - protein, 464 aa, Populus balsamifera subsp. trichocarpa
  misc_feature: Ceres ANNOT ID no.1483984
  misc_feature: Score of 498.0 for HMM of FIGURE 2.
  misc_feature: Functional Homolog Of Ceres SEEDLINE ID no. ME06748 at SEQ ID NO. 41
  misc_feature (130)..(150): Pfam Name: IQ Pfam Description: IQ calmodulin-binding motif
MAKKRSWFYRVRRLFTSDTQSRQEKERRRKWMFFGKFKVKNRLASIAAPSSPLREEAEKEQSKHALSVALATAAAAEAAVVAAQAAAEVVLLTGVPHSINEYEKETDHLAFEVQGDAPHSTHQHARGIKELAAIKIQATFRGYLARKALRALKGIVKLQAIIRGRNVRRQAMTTLKCLQSIVNIQSQVCAKRIQMVEGAWTCSENKQLENLSDKIIKMDMNSERRWDSSLLTKEEAVASFLSKKEAAIKRERIREYWFNRRNSAESERSKPSGRWRYWLDQWVDTQLVKSKELEDLDSVLTSNPKPGVEYRGKQIKLRGLQRLYHLDSVDSPISAPRKSFHRKQCSLGEDNSFSRSPVVPTYMATTESAKAKTRSMSSPKLRPGSFDAYSDSYSPCKNKLSLISSTTTEVPSSARYGRPSAYQQRSPSLKGLPGPIKCNRPTSKVLSFDSDCSLKTWDKQSSFR

SEQ ID NO: 53 - DNA, 1579 bp, Gossypium hirsutum
  misc_feature: Ceres CLONE ID no.1924654
  misc_feature: Encodes the peptide sequence at SEQ ID NO 54
aaggaaaaaaaactatagctttcttcgtttatgtaatggaattcctcgccaattctctctcaatctaagctatccaagttccaaagactaaagcttttttgaagcggtgattcctgtttgattctcccaaaatatttaagtattcagtgcaccttttatacacaatccatatggaatttaccactatactatattatataagatgatgttaggatgcagaaatgtaaaaattcagaatagtagtacctgaagaagtgagagttctttaatggcgaagaagaagagctggttcaatctagtgaagaggttctttctctttgagacacttataaatgcacaaaaggataacagaaggaaatggatgtttggaaggtttaggaccaaaaggttagcatccattaaagctccatcaccaccaagagacagcataaaatatgaaacagaggaggaccagaagaaacatgccttaacagtggcaattgccgcagtggctgctgctgaagcagctgttgcagctgctcaggttgcagccgaggttgttcgcctcacaggcaatgacgcccctaaagctaaagaagaacaaaccaatgatgttaaacctgactgttcttcatctagtgagcttggcaacaagttccaacaacttgctgctataaaaatccaggcttcttttcggggttaccttgcaaggaaagctttgagagcattgaaagggatagtgaagcttcaagcaattattcgaggccgagttgtgagacgacaagcattgactgctttaaaatgcttgcaatcgattgtaaacattcagtctcaagtttgtgcaaggagattccaaattgtagaaggcacttggcaacaacatgatgagaacaaagagttgataactttgaaagataagattcttaaggtggataccaacagtcaaacaagatgggacaattgtaatggaggattgaagtactggttagaccaatgggtggatactaaaagtaaagatgttgaagtcgaagacatagactcggtttggacttcgaaccgcaagcctacgaggctcaagactttttcgagacagtatcattgtgatgcagaaggggtagattctccggtacgggttcaaggacgacgatcatttcatggaaagcagagttctttaggagaagatagttcttttattacatctcctgtagttccaacttacatggcagcaacacaatctactaaagcaaaggtaaggtcaatgagttcaccaaagctaaggccaggaacttgtgatactcaatccgaaagctattcaccatataagaacaagtcgtgtctcctatcttcagttacaagcaagcctaacgcttatgagcagagatccccaacactaaagggtgtaaagtcaaagaaaaccttgaaggatcttagctttaactcttaatgttcattgcctaattgggtgcaaaaaagcaccttcaaatgactcgaccattgtgatgttttaggtcccttggaagcaagtctttgttattgtgtttgtgtgagattgctgatgctgttttgtgcttaaacaattgaatgaatcaagttttgtgtg

SEQ ID NO: 54 - protein, 384 aa, Gossypium hirsutum
  misc_feature: Ceres CLONE ID no.1924654
  misc_feature: Score of 679.6 for HMM of FIGURE 2.
  misc_feature: Functional Homolog Of Ceres SEEDLINE ID no. ME06748 at SEQ ID NO. 41
  misc_feature (125)..(145): Pfam Name: IQ Pfam Description: IQ calmodulin-binding motif
MAKKKSWFNLVKRFFLFETLINAQKDNRRKWMFGRFRTKRLASIKAPSPPRDSIKYETEEDQKKHALTVAIAAVAAAEAAVAAAQVAAEVVRLTGNDAPKAKEEQTNDVKPDCSSSSELGNKFQQLAAIKIQASFRGYLARKALRALKGIVKLQAIIRGRVVRRQALTALKCLQSIVNIQSQVCARRFQIVEGTWQQHDENKELITLKDKILKVDTNSQTRWDNCNGGLKYWLDQWVDTKSKDVEVEDIDSVWTSNRKPTRLKTFSRQYHCDAEGVDSPVRVQGRRSFHGKQSSLGEDSSFITSPVVPTYMAATQSTKAKVRSMSSPKLRPGTCDTQSESYSPYKNKSCLLSSVTSKPNAYEQRSPTLKGVKSKKTLKDLSFNS

SEQ ID NO: 55 - DNA, 1032 bp, Populus balsamifera subsp. trichocarpa
  misc_feature: Ceres ANNOT ID no.1468861
  misc_feature: Encodes the peptide sequence at SEQ ID NO 56
atgaaggcaaggagagcactaagggcactaaaagctttggtgaagcttcaagccttagtgagaggccacattgtgagaaagcaaacagcagacatgcttaggcgtatgcagacattagtgagactgcaggctcgagcccgtgctagtcgcagttatgtgtcggactcatcgcacactactggcaagtcctctcattctcgttatgctgtccctgcaagtccttcaaaggatcacctgtttcgtgtttctagtaccaaatttgatgggccctcgattctcaagagatgtggttcaaatgcaaactttagggagagcattgactttgacaaagtaaaatggggttcgaactggctagaccgttggatggaagaaagttttttgaatgaccatggcagcaatccaccgagaagtcgaaatgctgatgatgagaagagtgacaagattcttgaagtggacacttggaagccccatgtgaaatcccaacaaagtaatagaacatttcagacttcacagcatgctttggcttcagatcataacaatcagagctttatgacttttgactctatgtcaaaactatcaaaaaaagaaccgaatccaatgccgagcatctcttcaggagaaattttgcagtctcttaaattacctctaggaaatgatgaagcagtttataggaccgctgagaatagccctcgaatgttctctgcaacatctagacctggaagtagtggtcggagaggaggcccttttacaccaacaaggagtgagtgctcgtggggcttctttaatggatactcgggttaccccaactacatggctaacactgaatcatctcgagccaaggtcaggtcacaaagtgccccaaggcagaggctagagtttgagaaatatggttcaagcagaagatctgttcaggggtattctgattcagaaactcgttcagaaaggggttttgctcaaaatactgaacttcaaaacaaagcttacgtagcatctggctacttgaatagactagggacttccgacttgaggtga

SEQ ID NO: 56 - protein, 343 aa, Populus balsamifera subsp. trichocarpa
  misc_feature: Ceres ANNOT ID no.1468861
  misc_feature: Score of 100.0 for HMM of FIGURE 2.
  misc_feature: Functional Homolog Of Ceres SEEDLINE ID no. ME06748 at SEQ ID NO. 41
  misc_feature (10)..(30): Pfam Name: IQ Pfam Description: IQ calmodulin-binding motif
MKARRALRALKALVKLQALVRGHIVRKQTADMLRRMQTLVRLQARARASRSYVSDSSHTTGKSSHSRYAVPASPSKDHLFRVSSTKFDGPSILKRCGSNANFRESIDFDKVKWGSNWLDRWMEESFLNDHGSNPPRSRNADDEKSDKILEVDTWKPHVKSQQSNRTFQTSQHALASDHNNQSFMTFDSMSKLSKKEPNPMPSISSGEILQSLKLPLGNDEAVYRTAENSPRMFSATSRPGSSGRRGGPFTPTRSECSWGFFNGYSGYPNYMANTESSRAKVRSQSAPRQRLEFEKYGSSRRSVQGYSDSETRSERGFAQNTELQNKAYVASGYLNRLGTSDLR

SEQ ID NO: 57 - DNA, 1646 bp, Glycine max
  misc_feature: Ceres CLONE ID no.1641776
  misc_feature: Encodes the peptide sequence at SEQ ID NO 58
ctctctctcaaaacccaaaactattcccttgtgagaactgaggagacataataatgggtaaggcgtcgaagtggtttcgcgggcttcttggtctcaaaaaaacagagtatgccacctcacccgccaagcctcccaaagagaaacgccggtggagcttcgttaaatcatcatacacagaaaaagacaacaccactgccgccacgtgtccaccactaagaaacaacaacaaccacgcaatggcagtagcagcagccaccgctgcggtggccgaagcggcggtggctgccgccgaagcagccgccgtcgtggtgagactaactagtaacagcggcaggtgcgccgacggcggacccacccggattcgccaacattgggctgctgttaagattcaagccgcttttcgtggctgtttggcaaggagagcactgcgagcattaaagggattggtgaagttgcaagcattggtgagaggccacattgagagaaaacggacggcagagtggctgaaaagattgcaagcactcttacatgcacagacccaagtttctgcagggttgaccctgcatgcctcaccttcgagttcaaagttatcaagccacctccaaggtccagaaacacccgaaaaatttgaaagccccattagatctaagagcatgaaacatgagcactcacctatactcaagagaaatggctccaaatcctgtgccctgatcaatggctatcaagagatatgtgggagtagatcagagagtcaagggaatgaacaattatggaactcaggaagatcaatgaatagagcacacggctccaatgatgaaagaaatggcaaggttcttgaagttgattctggaaaaccgcacttcacactaaagcgtcgaaacctctcttactccacaggctctgatctttatagtaagagtttgaacagcacaaaggaatcaacatctcttcaatctgctcaaagtccatgttgtgaggttcagtctcacagttacagctcgcaaaaagtgaacaatgaggttgaggagagtccattctgcactgctgacaatagtccacaatacttatctgcctcttctaaagatgatggcttcaaaagaagcccttttactcctactagaagtgatggctctagaagctacattcgcggttaccctgattatcctagttacatggcatgcactgaatcttcaaaggcaaaggccagatctctgagtgcaccaaaacaaaggcctcaaagtgagaggtctggttcatcggatagatactcactcaatggatttgatatgtcaagattggccactcaaagggcaatgcaagcaagcttcaccaacaaagcatatccaggttctggtcgtttggacaagcttggtatgcctgtggggtacagattctgattgagttatgtttatggtaagagggttattttgtatcttttatttttcatagtcttaaagtcttaatatctgatcttgctaaccaaccggctgtactttgagcttccattgcgattttgtgtcagcattagaaatctacaaccaaattaagtgcatactgctaagtctcaactttcaagtcattttattacttggataaactgtgtaaaagaattattatctttgcctttcaaaaaaaaaaaaaaaaaa

SEQ ID NO: 58 - protein, 447 aa, Glycine max
  misc_feature: Ceres CLONE ID no.1641776
  misc_feature: Score of 433.6 for HMM of FIGURE 2.
  misc_feature: Functional Homolog Of Ceres SEEDLINE ID no. ME06748 at SEQ ID NO. 41
  misc_feature (106)..(126): Pfam Name: IQ Pfam Description: IQ calmodulin-binding motif
MGKASKWFRGLLGLKKTEYATSPAKPPKEKRRWSFVKSSYTEKDNTTAATCPPLRNNNNHAMAVAAATAAVAEAAVAAAEAAAVVVRLTSNSGRCADGGPTRIRQHWAAVKIQAAFRGCLARRALRALKGLVKLQALVRGHIERKRTAEWLKRLQALLHAQTQVSAGLTLHASPSSSKLSSHLQGPETPEKFESPIRSKSMKHEHSPILKRNGSKSCALINGYQEICGSRSESQGNEQLWNSGRSMNRAHGSNDERNGKVLEVDSGKPHFTLKRRNLSYSTGSDLYSKSLNSTKESTSLQSAQSPCCEVQSHSYSSQKVNNEVEESPFCTADNSPQYLSASSKDDGFKRSPFTPTRSDGSRSYIRGYPDYPSYMACTESSKAKARSLSAPKQRPQSERSGSSDRYSLNGFDMSRLATQRAMQASFTNKAYPGSGRLDKLGMPVGYRF

SEQ ID NO: 59 - DNA, 1434 bp, Populus balsamifera subsp. trichocarpa
  misc_feature: Ceres ANNOT ID no.1438750
  misc_feature: Encodes the peptide sequence at SEQ ID NO 60
atgggcaaagcttccaaatggttccgtgccgttctcggattaaaaaaacccgacccaccactagaccacccccaaaccactcgttctaaagacaaacggagatggagttttgttaagtcccgccgtgaaaaagaccacgaccaccaacagcgacaacaagatattgaagccagtaaaactggtgttctgtacgggcaggagtttgaggaggaccccaacaagcatgcggtcgctgtggctgctgctaccgctgcagtcgcggaggctgctgttgcagcggctcaggcagctgccgaggttgtgagacttacgagtagtgggaggtgtgttaataacagtgtcgcgaacgttagcgggagtcttggattacgtgaagacctcgctgctgttaagattcaagctgctttccgtggctacctggctaggagagcattacgggcgttaaaggcattggtgagacttcaagctctggtaagaggtcacattgagaggaagcgaactgcagagtggcttcatcgaatgcaagctttgctgcgagcgcagtctcgagcacgttctggacgtgcccaaatttctgaatcttctcattcaagtagcaagtcctctcgctttcaacaccctggtccgccaacccctgaaaaattcgagcatgccattcgtgccaggagtggaaaatatgaacaatcatcaatacttaagagaactgggtcaaaatgtaaaggcagagcaattggtgatctagacgttgcacacttatccttaaattggtcagagcgtcggatggatgatcaaacatgggatcaccaagtccctttggcaggaactggcactattgatgatgataagagtgacaagatccttgagattgatactggaaaaccccacattactcccaagcgtagaaatctctttcactcttctcacctttccctgtcagatcagtatagccatagtttcacaactacaaaagactcgacagcccatcaaactgttccaagtccctcatcttgtgaagttcaatctttaagtccattgaagttttctcatgttgtcgaagaagcattatgcactgctgaaaatagcccacagttctactctgcatcatcaaggggtggtagtagtaagagaagtcccttcactcccagtaggagtgatggctcaagaaacttcctaatcggttattatggctacccaaattatatgtgtaacactgaatcttcgagggctaaggcgagatctcttagcgctccaaaacaaagaccccaatatgagagatccagttcaaccaggagatactcggttctcgggtgtggtgagccaagatcgagtagtgcacagcatgcttctgccttgcgtgcaagtttttcaagcaaagcttaccctggatctggtcgcttggacaagctgggaatgcctattgggcagggatactaa

SEQ ID NO: 60 - protein, 477 aa, Populus balsamifera subsp. trichocarpa
  misc_feature: Ceres ANNOT ID no.1438750
  misc_feature: Score of 852.9 for HMM of FIGURE 2.
  misc_feature: Functional Homolog Of Ceres SEEDLINE ID no. ME06748 at SEQ ID NO. 41
  misc_feature (126)..(146): Pfam Name: IQ Pfam Description: IQ calmodulin-binding motif
MGKASKWFRAVLGLKKPDPPLDHPQTTRSKDKRRWSFVKSRREKDHDHQQRQQDIEASKTGVLYGQEFEEDPNKHAVAVAAATAAVAEAAVAAAQAAAEVVRLTSSGRCVNNSVANVSGSLGLREDLAAVKIQAAFRGYLARRALRALKALVRLQALVRGHIERKRTAEWLHRMQALLRAQSRARSGRAQISESSHSSSKSSRFQHPGPPTPEKFEHAIRARSGKYEQSSILKRTGSKCKGRAIGDLDVAHLSLNWSERRMDDQTWDHQVPLAGTGTIDDDKSDKILEIDTGKPHITPKRRNLFHSSHLSLSDQYSHSFTTTKDSTAHQTVPSPSSCEVQSLSPLKFSHVVEEALCTAENSPQFYSASSRGGSSKRSPFTPSRSDGSRNFLIGYYGYPNYMCNTESSRAKARSLSAPKQRPQYERSSSTRRYSVLGCGEPRSSSAQHASALRASFSSKAYPGSGRLDKLGMPIGQGY

SEQ ID NO: 61 - DNA, 1431 bp, Populus balsamifera subsp. trichocarpa
  misc_feature: Ceres ANNOT ID no.1447395
  misc_feature: Encodes the peptide sequence at SEQ ID NO 62
atgggtaaagcttccaaatggttccgtgccgttctcggcctcaaaaaacccgacccaccaccagaccgccccgttacaactcgttctaaagaaaaaaggagatggagttttgtcaagtcccaccgtgaaaaagaccaacaccatcaccaacagcaacaacaagagacggaagccgttaaagcaggcgttttgtacgggcaggagtttgaggaggacccaaacaagcatgcgatcgctgtggctgctgctactgctgcagttgcggaggctgcagttgctgccgcgcaggcagctgcagaggtggtgcggttaacaagcagtgggaggtgtgttgataacagtgttgcgtacgttagcgggagtcctggcttacgtgaagacttcgctgctgttaagatcgaagctgcttttcgtggctacctggcaaggagagcgttaagagcattaaaagcgttggtgaggcttcaggcactggtaagaggtcaccttgagaggaagcgaacagcagagtggcttcatcgaatgcaagcattgctgagagcgcaggctcgagcacgtgcaggacgtgcccaaatttctgaatcctcccactcaagcagcaagtcttctcgctatcacctccctggtctgccaacccatgaaaaatccgagcatgccattcgtgctacgagtggaaaatatgaacaatcatcaatgcttaagagaactgggtcaaaaactaaaggcagagaaattgccgatcaagatgttgcacacttatccttcaattggtcagaacatggaatggatagtagaacatgggatcatcaagccccttcgccaggaactggccccattgatgatgacaagatccttgagattgattctggaaaaccacatattactcctaaacgcagaaatctctttcacccttctcacctttccttgtctgcggatcagtatagccatagtttcacaacatcaaaaggctccacagtccgtcaagcagttccaagcccctcatctggcgaagttcaatctttcagtccattgaaattctctcatgaggttgaggaagcattttgcaccgctgataatagcccgcaattctgctctgcatcatcaaggggtggcagtggtaagagaagtcccttcactcccagtaggagtggtggctctagaagcttcatgagtggatactctgactacccaaattatatgtgtaacactgaatcttcaagggctaaggtgagatctctaagcgctccaaaacaaagaccccagtatgagagatccagctcaaccaagagatactcggttctcggctttggtgaacaaagatcgagtagtgcacagagtgcttctgccttgcgtgcaagttttacaagtaaagcttaccctggatctggtcgtttggacaggctgggaatgcctgttgggcagaaatactaa

SEQ ID NO: 62 - protein, 476 aa, Populus balsamifera subsp. trichocarpa
  misc_feature: Ceres ANNOT ID no.1447395
  misc_feature: Score of 696.6 for HMM of FIGURE 2.
  misc_feature: Functional Homolog Of Ceres SEEDLINE ID no. ME06748 at SEQ ID NO. 41
  misc_feature (149)..(169): Pfam Name: IQ Pfam Description: IQ calmodulin-binding motif
MGKASKWFRAVLGLKKPDPPPDRPVTTRSKEKRRWSFVKSHREKDQHHHQQQQQETEAVKAGVLYGQEFEEDPNKHAIAVAAATAAVAEAAVAAAQAAAEVVRLTSSGRCVDNSVAYVSGSPGLREDFAAVKIEAAFRGYLARRALRALKALVRLQALVRGHLERKRTAEWLHRMQALLRAQARARAGRAQISESSHSSSKSSRYHLPGLPTHEKSEHAIRATSGKYEQSSMLKRTGSKTKGREIADQDVAHLSFNWSEHGMDSRTWDHQAPSPGTGPIDDDKILEIDSGKPHITPKRRNLFHPSHLSLSADQYSHSFTTSKGSTVRQAVPSPSSGEVQSFSPLKFSHEVEEAFCTADNSPQFCSASSRGGSGKRSPFTPSRSGGSRSFMSGYSDYPNYMCNTESSRAKVRSLSAPKQRPQYERSSSTKRYSVLGFGEQRSSSAQSASALRASFTSKAYPGSGRLDRLGMPVGQKY

SEQ ID NO: 63 - protein, 484 aa, Arabidopsis thaliana [sequence omitted]

SEQ ID NO: 64 - protein, 543 aa, Arabidopsis thaliana
  misc_feature: Public GI ID no.3292832
  misc_feature: Score of 277.0 for HMM of FIGURE 2.
  misc_feature: Functional Homolog Of Ceres SEEDLINE ID no. ME06748 at SEQ ID NO. 41
  misc_feature (167)..(187): Pfam Name: IQ Pfam Description: IQ calmodulin-binding motif
MGKASRWFRSLFGVKKPDPGYPDLSVETPSRSTSSNLKRRWSFVKSKREKESTPINQVPHTPSLPNSTPPPPSHHQSSPRRRRKQKPMWEDEGSEDSDKHAIAVAAATAAVAEAAVAAANAAAAVVRLTSTSGRSTRSPVKARFSDGFDDVVAHGSKFYGHGRDSCELAVIKIQSIFRGYLAKRALRALKGLVRLQAIVRGHIERKRMSVHLRRMHALVRAQARVRATRVIVTPESSSSQSNNTKSSHFQNPVSLVKFPMIVPFNLKHGPPTPEKLEHSISSRSSKLAHSHLFKVLHFQLLFVSSVFVACGPISSKFQRLYKLLTLLYVQNKSNLKNWNGSKASDNNRLYPAHRETFSATDEEEKILQIDRKHISSYTRRNRPDMFYSSHLILDNAGLSEPVFATPFSPSSSHEEITSQFCTAENSPQLYSATSRSKRSAFTASSIAPSDCTKSCCDGDHPSYMACTESSRAKARSASAPKSRPQLFYERPSSKRFGFVDLPYCGDTKSGPQKGSALHTSFMNKAYPGSGRLDRLGMPIGYRY

SEQ ID NO: 65 - DNA, 1799 bp, Zea mays
  misc_feature: Ceres CLONE ID no.1559074
  misc_feature: Encodes the peptide sequence at SEQ ID NO 66
aagactctcccagtcccttcctctcctgctgcctttctctcttctcggtgaagcgtgtgttcatttcactgttttggtttcatctcccgctctttctttaccccgtgctccggccaagtgctggaaccaagaaagcctcatggggcggccggccgacgggcggtagagaggcggagatgggctgggcgcctaggtggctgcgcgggctgctcggcggcggcaggaaggccgccgtgacgaagccggcgaaggagaagaagctctggggattcgggaagtccttccgggaaaaggaccccgcgccagcgccggaacggcctcggacgccttcggtgcagcccacggcgacgcctcgccgggggtttgcggcggcgccggatgaggcggacgacgagcagagcaagcgtgctatcgctgtggccgcggcgacggcggcggtggcagaggccgccgtcgctgctgcccaggcggccgccgccgtggtgcggttgacgagctccggccggtgcccaccgccggccgccgcgaagcgggaggagtgggcggctgttcggatccaggccgctttccgtggctacctggcgaggcgggcgctgaaggcgttgagggggctggtgaagctgcaggcgctggtccggggcaacattgtgcggcggcaggcggcggagacgctgcgatgcatgcacgcgctcgtccgcgtccaggcgcgcgcgcgcgcgtgtcgcgcaattcgctcgcagcatgtcgcggctcatccggatccgccaacgccggagaagtacgatcaggcgggtgcccccaggcacgcccgttccggctctctgaaggcaaactcttccaagacgccgggcggcgagaggctgggtagggagaggtcggaatcttgcgggaggaactggctggaccgctgggtggaggagaggtacacggacgacgagaagaacgccaagattctcgaagtggacaacggcaagccagggcggcacggttccaagcggcgcggcggcaaccatcaccagtcgccgtgctcgacgatgacctccgagcagaacagccggagctacgcgaccatgccggagtcgccgtccaaggactcgacgaccgcgcagcagtccgtgccgagcccgtcgtccgtgggcatggctgccgaggccctgagcccgctgcgcgtgccagcggacatcgccgagctctgcgacagcccccagttcttctcggcgacgtcgcggcccgggagctccaggagggggggcgcgttcacgccggcggccaagagcgagtgctcgcgcagcctcttcggcggctactccgactgccccaactacatggcgaacacggagtcgttccgcgccaaggcgcgttcccagagcgcgcccaagcagaggccgcagcagcagtacgagaagtcgggctccctccgcagggcgtcggcgcacgccctcgcggcggggccggcagcggcacagaggtcggtggcctcgttgcacgccatgaaggcgtatccgggctccggcagattggaccgacttggcatgccggtcaggtactgatccggatcctacctagctcgcttcaggataatgtggtgctgcgcctgaactgattgatacccagtgtctcaactcaagcgatgaggatgaagtgaattctactagtggtcgttattagatcttgttccttcggtggtgcctattaccgtcaacagttttctgtttgttgctttgtgtagcgaagtgtaagttgctggtacgtagctggtaatactatgcgtgcttaaccgcgaaaaaaaaaaaaaaaaa

SEQ ID NO: 66 - protein, 457 aa, Zea mays
  misc_feature: Ceres CLONE ID no.1559074
  misc_feature: Score of 855.0 for HMM of FIGURE 2.
  misc_feature: Functional Homolog Of Ceres SEEDLINE ID no. ME06748 at SEQ ID NO. 41
  misc_feature (121)..(141): Pfam Name: IQ Pfam Description: IQ calmodulin-binding motif
MGWAPRWLRGLLGGGRKAAVTKPAKEKKLWGFGKSFREKDPAPAPERPRTPSVQPTATPRRGFAAAPDEADDEQSKRAIAVAAATAAVAEAAVAAAQAAAAVVRLTSSGRCPPPAAAKREEWAAVRIQAAFRGYLARRALKALRGLVKLQALVRGNIVRRQAAETLRCMHALVRVQARARACRAIRSQHVAAHPDPPTPEKYDQAGAPRHARSGSLKANSSKTPGGERLGRERSESCGRNWLDRWVEERYTDDEKNAKILEVDNGKPGRHGSKRRGGNHHQSPCSTMTSEQNSRSYATMPESPSKDSTTAQQSVPSPSSVGMAAEALSPLRVPADIAELCDSPQFFSATSRPGSSRRGGAFTPAAKSECSRSLFGGYSDCPNYMANTESFRAKARSQSAPKQRPQQQYEKSGSLRRASAHALAAGPAAAQRSVASLHAMKAYPGSGRLDRLGMPVRY

SEQ ID NO: 67 - DNA, 1821 bp, Panicum virgatum
  misc_feature: Ceres CLONE ID no.1726548
  misc_feature: Encodes the peptide sequence at SEQ ID NO 68
gtctagacccttcctttctctcctgctgtcccttttgctcttctcggtgtaagcgtgtgcgcgtttcactgctttggtttcatctcccgctctttctttcctccccactgctcctccggccaagtgctggaacgaggaagcctcatgcggccgccggccggggagcggtagagcgccggagatgggctgggcgcccaggtggctgcgcgggctgctcggcggcggcaacaaggccgccgagacgaagcccgtgaaggaaaagaggcgctgggggttcgggaagtccttcagggagaaggcgccggcgccggtggcggcgcggcctccgacgccgccggtgcagcccacggcgacgcctcgccggggctacgcgccggcgccggacgaggcggacgacgagcagagcaagcgcgccatcgcggtggccgcggccactgcggcggttgcggaggccgccgtagccgcggcgcaggcggccgccgccgtggtgcggctgacgagcagcgggcggtgcgcgccggccgccgccaagcgggaggagtgggcggctgttcggatccaggccgctttccgtggatacctggcgaggcgggcgctcaaggcgctgcgggggctggtgaagctgcaggcgctggttcggggcaacatcgtgcggcggcaggcggcggagacgctgcggtgcatgcacgcgctcgtccgcgtccaggcgcgcgcccgcgcctgccgcgcaattcgctcgcagcaggtcccggctcacccagatccgccgacgccggagaagtacgatcaggcgggtgcccccaggcacgggcgttccggctctctaaaggggagctcgtcgaagacaccgggcagcgagaggctgggcagggagaggtcggaatcttgcgggaggaactggctggaccggtgggtggaggagaggtacatggacgacgagaagaacgccaagatcctggaggtggacaacggcaagccagggcggtatgcttccaagaggcgcggcggcggcggcaaccagcaccagtcgccgtgctcgacgatgacgtccgaccagaacagccggagctacgcgaccatgccggagtcgacgaccgcgcagcggtccgtgccgagcccgccgtcggtgggcatgggcgaggccctgagcccgctccgcctgcccgtggacattgccgagctctgcgacagcccacagttcttctcggcgtcgtctcggccggggagctcccggcgggggcccttcaccccgagcaagagcgagtgctcccgcagcctcttcgggggctactccgactaccccaactacatggccaacacggagtcgttccgcgccaaggcgcgctcccagagcgcgcccaagcagaggccgcactacgacaagtccagctccctccgcaaggcgtcggcggcgcaggcctacttgacggggccgtgcgcgccgacggcgcagcagaggtcggcggcctcgctgcacgccaagttcaccaacaaggcgtacccgggctctggcaggctggatcgactcggcatgcccgtcaagtactgatcctgttatgttatcctaccaaagttgctttctggagtggtgttgcttcttgagcgatcagtgtctcagctctcgagcaaggtcgatgaagtaaaatctagtagtggtcgttaggcttttgtgtgccttcctggtgctgttaccctcgacagttttctgtttcttgctttttaatagcgaagtgtaagttggtagtagctgcactgtaatactatctgtgctttaacagtttaactgctaagtgctaactccaaaaaaaaaaaaaaaaaaaa

SEQ ID NO: 68 - protein, 455 aa, Panicum virgatum
  misc_feature: Ceres CLONE ID no.1726548
  misc_feature: Score of 892.2 for HMM of FIGURE 2.
  misc_feature: Functional Homolog Of Ceres SEEDLINE ID no. ME06748 at SEQ ID NO. 41
  misc_feature (120)..(140): Pfam Name: IQ Pfam Description: IQ calmodulin-binding motif
MGWAPRWLRGLLGGGNKAAETKPVKEKRRWGFGKSFREKAPAPVAARPPTPPVQPTATPRRGYAPAPDEADDEQSKRAIAVAAATAAVAEAAVAAAQAAAAVVRLTSSGRCAPAAAKREEWAAVRIQAAFRGYLARRALKALRGLVKLQALVRGNIVRRQAAETLRCMHALVRVQARARACRAIRSQQVPAHPDPPTPEKYDQAGAPRHGRSGSLKGSSSKTPGSERLGRERSESCGRNWLDRWVEERYMDDEKNAKILEVDNGKPGRYASKRRGGGGNQHQSPCSTMTSDQNSRSYATMPESTTAQRSVPSPPSVGMGEALSPLRLPVDIAELCDSPQFFSASSRPGSSRRGPFTPSKSECSRSLFGGYSDYPNYMANTESFRAKARSQSAPKQRPHYDKSSSLRKASAAQAYLTGPCAPTAQQRSAASLHAKFTNKAYPGSGRLDRLGMPVKY

SEQ ID NO: 69 - protein, 464 aa, Oryza sativa subsp. japonica
  misc_feature: Public GI ID no.115459996
  misc_feature: Score of 886.1 for HMM of FIGURE 2.
  misc_feature: Functional Homolog Of Ceres SEEDLINE ID no. ME06748 at SEQ ID NO. 41
  misc_feature (124)..(144): Pfam Name: IQ Pfam Description: IQ calmodulin-binding motif
MGWASRWLRGLLGGGKKPNSGSGDPKPAREKKRWGFGKSFREKSPAHPPPPPPPSAAVQRAVTPRRAYTASDEGDDEQSKRAIAVAAATAAVAEAAVAAAQAAAAVVRLTSSGRCAPAAAKREEYAAVRIQAAFRGYLARRALKALRGLVKLQALVRGNIVRRQAAETLRCMHALVRVQRRARACRAIRSQHVSAHPGPPTPEKYDQATHEGVPKHGRSGSLKGSSSKTPGSERLTRERSESCGRNWLDKWVEERYLDDEKNAKILEVDTGKPGRHASRRRSGSHHHHSSCSSMTSEQKSRSYATMPESPSKDSTTAQQSVPSPPSVGMAEALSPLLMAVDIAELCDSPQFFSATSRPGSSRSRAFTPTKSECSRSLFGGYSDYPNYMANTESFRAKARSQSAPKQRPQYEKSSSLRKASAHAFGPGSCAPVAQRTTASLHSKFTNKAYPGSGRLDRLGMPVKY

SEQ ID NO: 70 - DNA, 1736 bp, Triticum aestivum
  misc_feature: Ceres CLONE ID no.697034
  misc_feature: Encodes the peptide sequence at SEQ ID NO 71
gcctagactcttcgtctccgtcctgcacctttttcttctctggcaagcctgtgcctgtgcgcgtcgcgccgttttgggtttcatctcccgctctttcttcctcctccctgctccggccaagtgctggaaccaagagaaggcgatgggggcggcggcggaggagcagtagccggagggaggggatggggtgggcttcaaggtggctccgcgggctgcttggcggcggcaagaaggccggtcccgcctccggcgagcacaagccggagagggagaagaagcgctggggcttcggcaagtccttccgggagaaggacccggtgcgtccaccgacgcctcctgtgcagcgggcggcgacgccccgccgcacctacgcgacgtcggatgacggcggcgacgagcagaacaaacgcgctatcgccgtggcggcggcgacggcggctgtggccgaggccgccgttgccgcggcgcaggcggccgccgccgtggtgcggctgacgagcagcgggcggtgcccgccggccggggcgaagcatgaggagtgggcggccgtccggatccaggccgctttccgtggctacctggcgaggcgcgcactgaaggcgctccgcgggctggtgaagctgcaggcgctggtccgcggcaacatcgtccggcggcaggcggccgagacgctccggtgcatgcaggcgctcgtcagcgtgcagtcccgcgcgcgcgccagccgcgcaacccgatcccgccaggccgcggcacacccgggcgcgacgacgccggagaagtacgagcaggcggcatacgatggcgcgctcaggcacggccgttcaggctcactcaagggaggctcgtcaaagacaccgggcagcgagaggatgagcagggagaggtcagaatcttgcgggaggaactggctggatcggtgggtggaggagaggtacatggatgacgagaagaacgccaagattctcgaggtggaccccggcaagcccggccggcacgcttccaagaggcgaagcagcggcggcggccaccaccagtcgtcgtgctcaaccaggacatcagagcagaacagccggagctacgcgacgatgccggactcgccgtccagggactcgacgacggcgcagcagtccgtgcccagcccgtcgtcggtgggcatgggcgcgggcgaggccctcagcccgctgcacatgccggcagacctcgcggcggagctgtacgagagcccgcagttcttctcggcgacgtcgcggccggggagctcgaagcggggcgccttcttcacgccgaccaagagcgagtgcgcgcgcagcctcttcggcggctactccgactaccccaactacatgtccaacacggagtcgttccgggccaaggcgcggtcgcagagcgcgcccaagcagcggccgctgtacgagaagtccgggtccctccggaaggcgtcggcacacgccttcgcgccggggcagaggtcgtcggcgtcggcgtccctgcacgccaggttcaccaataaggcgtaccctggctccggcaggctggaccggctgggcatgcctgtcaagtactgaaccctgccgccatgtgaccagtgttaggtttgagcttttgtgatgctattaccgtcagaaagtactttcctgttattgactgtgacttgttaagtgtaagttgctactgtactggtgttcccgcaaaaaaaagtgtaagttgctagtaatcacccaaaaaaaaaaaaaaaa

SEQ ID NO: 71 - protein, 460 aa, Triticum aestivum
  misc_feature: Ceres CLONE ID no.697034
  misc_feature: Score of 750.1 for HMM of FIGURE 2.
  misc_feature: Functional Homolog Of Ceres SEEDLINE ID no. ME06748 at SEQ ID NO. 41
  misc_feature (119)..(139): Pfam Name: IQ Pfam Description: IQ calmodulin-binding motif
MGWASRWLRGLLGGGKKAGPASGEHKPEREKKRWGFGKSFREKDPVRPPTPPVQRAATPRRTYATSDDGGDEQNKRAIAVAAATAAVAEAAVAAAQAAAAVVRLTSSGRCPPAGAKHEEWAAVRIQAAFRGYLARRALKALRGLVKLQALVRGNIVRRQAAETLRCMQALVSVQSRARASRATRSRQAAAHPGATTPEKYEQAAYDGALRHGRSGSLKGGSSKTPGSERMSRERSESCGRNWLDRWVEERYMDDEKNAKILEVDPGKPGRHASKRRSSGGGHHQSSCSTRTSEQNSRSYATMPDSPSRDSTTAQQSVPSPSSVGMGAGEALSPLHMPADLAAELYESPQFFSATSRPGSSKRGAFFTPTKSECARSLFGGYSDYPNYMSNTESFRAKARSQSAPKQRPLYEKSGSLRKASAHAFAPGQRSSASASLHARFTNKAYPGSGRLDRLGMPVKY

SEQ ID NO: 72 - DNA, 1433 bp, Zea mays
  misc_feature: Ceres CLONE ID no.353438
  misc_feature: Encodes the peptide sequence at SEQ ID NO 73
atgatgtgtaacctacgagctgctctggtaaccgcttcccctccagcaaggagaacgccaccttgtggcgtcagctctgccgtcgtctttactgcctgcgccttccaggcttcttcgtttcaggaagcaaggcgaggcgggcgctgaaggcgttgcgggggctggtgaagctgcaggcgctggtccggggcaacatcgtgcggcggcaggcggcggagacgctgcgatgcatgcacgcgctcgtccgcgtccaggcgcgcgcgcgcgcctgccgcgcaattcgctcgcagcatgtcacggcgcatccggacccgccgacgccggagaagtacgagcaggcgggtgcggccaggcacggccgttccggctctctgaaggcgaactcttcgaggacaccgggcggcgagaggctgggcagggagaggtcggaatcctgcgggaggaactggctggaccgctgggtggaggagaggtacatggacgacgagaagaacgccaagattctcgaggtggacaacggcaagccagggcgccggtatgcttccaagaggcgcggcggcggcggcgtcggcggaaaccaccaccaccagcaccaccagtcgccgtgctcgacgacgatgggctccgagcagaacagccggagctacgcgaccatgccggagtcgccgtccaaggactcgacgaccgcgcagcagtcggtgccgagcccgccgtcggtgggcatggccgaggaggaggccctgagcccgctgcgcgtgcccgtgcccgcggacgtggccgagctctgcgacagcccccagttcttctcggccacgtcgtcgcggcccgggagctcgaggcggggcccgttcacgccgacggccaagagcgagtgctcgcgcagcctcttcggcggctactccgactacccgaactacatggccaacacggagtcgttccgcgccaaggcgcggtcgcagagcgcgccgaagcagaggccgcagtacgagcggtccagctccctacgcagggcgtcggcggcgcagaggtcggcggcggcggcggcctcctccctgcacgccaagttcaccaacaaggcgtacccgggctctggcaggctggatcggcttggcttgccggccaggtactgatactgagcctgcctaattcgcgtcaggatgatgtgctgccgctgtgtctcgagcgaggaggacgacgacgaagaagtgcaatcgactagtggtagttaggttccgccgtgccttggttgtgctattaccatcaacagttttttctgtttcttgctttgtgtagctagccatgtctaaagttgctggtagctgtaatgatgctataatgcgtgcttaactgctgacgaacctttttcctctacatttccgtggtatatatatatgtgccgtcaaatcatgcatgggaattgaatgtgttgttgc

SEQ ID NO: 73 - protein, 299 aa, Zea mays
  misc_feature: Ceres CLONE ID no.353438
  misc_feature: Score of 204.3 for HMM of FIGURE 2.
  misc_feature: Functional Homolog Of Ceres SEEDLINE ID no. ME06748 at SEQ ID NO. 41
MHALVRVQARARACRAIRSQHVTAHPDPPTPEKYEQAGAARHGRSGSLKANSSRTPGGERLGRERSESCGRNWLDRWVEERYMDDEKNAKILEVDNGKPGRRYASKRRGGGGVGGNHHHQHHQSPCSTTMGSEQNSRSYATMPESPSKDSTTAQQSVPSPPSVGMAEEEALSPLRVPVPADVAELCDSPQFFSATSSRPGSSRRGPFTPTAKSECSRSLFGGYSDYPNYMANTESFRAKARSQSAPKQRPQYERSSSLRRASAAQRSAAAAASSLHAKFTNKAYPGSGRLDRLGLPARY

SEQ ID NO: 74 - protein, 499 aa, Oryza sativa subsp. japonica
  misc_feature: Public GI ID no.125593074
  misc_feature: Score of 112.2 for HMM of FIGURE 2.
  misc_feature: Functional Homolog Of Ceres SEEDLINE ID no. ME06748 at SEQ ID NO. 41
  misc_feature (134)..(154): Pfam Name: IQ Pfam Description: IQ calmodulin-binding motif
MGKAARWFRNMWGGGRKEQKGEAPASGGKRWSFGKSSRDSAEAAAAAAAAAAEASGGNAAIARAAEAAWLRSVYADTEREQSKHAIAVAAATAAAADAAVAAAQAAVAVVRLTSKGRSAPVLAATVAGDTRSLAAAAVRIQTAFRGFLAKKALRALKALVKLQALVRGYLVRRQAAATLQSMQALVRAQATVRAHRSGAGAAANLPHLHHAPFWPRRSLVRRWLNLADDIAMYMFDVDVVCWRWMQQERCAGDDTRSEHGVAAYSRRLSASIESSSYGYDRRPQDRGGGHRGGPSRGRRRRGGRAPPLLLDARWVRERRRGLVRQLHVVAAPVLPPRRRAAAPHRRPDVAPLPRLRLVRAGEGPAGDGAEHAAVRARAADADQERVRRRRRRRHPLVAAQLPELHVQHAVVRGRRCRSQSAPKQRPETGGAGAGGGRKRVPLSEVVVVESRASLSGVGMQRSCNRVQEAFNFKTAVVGRLDRSSESGENDRHAFLQRRW

SEQ ID NO: 75 - DNA, 1807 bp, Gossypium hirsutum
  misc_feature: Ceres CLONE ID no.1920115
  misc_feature: Encodes the peptide sequence at SEQ ID NO 76
ctcctttcctcagtaagcttacgaaacttcttcttcgcttcttctctgcaaatgaatcccgagaaacctcccaaacccttatcttattaccctttttcaccttcttctccatcaccaaactaacgtttccgtacacaacgaacaaaatcaaagcaatgggtaaagcttccaagtggttccgcagcatcctcggcttcaaaaatccgacccccataaccaaccttctccttcttcttcaaaaccaacttcccataaagacaaacggcgttggagtttcgtcaaatcgtaccgtgaaaaagactcctccacgaacaatagtaatgcgaagttgccgtcgtcttcgcagcaacagaaagactctgtttccttcgttgaaaggaaaggtgacaatgaagtaacggatcctagcaagcacgccatcgctgttgctgccgctactgccgccgttgccgaagcagccgttgcggctgctcaagctgccgctgcggtggttaggctcactagtaacagtggtaggtgcgcgcgtgaatcggcagcggtttacgtttgcaacaacaatagctatatagcacacgatgagtcatccgccattaagatacaatctgcatttcgtggatacctggcaagaagagcattgcgagcactaaaaggattagtgagactccaagcattggttagaggtcatatagaaaggaagagaactgcagaatggttaagaaggatgcaagcattattgagagcacaagcacgtgctcgtgctggccgggcccaaatttccgagtcttcccaatcaagctgcaaatcgtctcacttccatcatccggatccagcaacccctgaaaaatttgaacatgttattcgatccaagggtacaaaatatgaacaatcatcaatgttgaagagaaatggatcaaagtcaagtggaaggactgttgataatcaagagaaattacactcaggttggtatcgccgtgttgatgagcaaacatgggagcattcaacaagaattggtcctaatgatgatgaaaagaatgacaaaatccttgaagttgacactgggaaaccaaatttcatctctaaacggagaaacctctttcattcaacacatctttctctgaattctgatttatatagctgtagtttcactaattcgagagactcacaccaaacagctcctagtccttcatctggtgaagttcagtctttaactccattgatgctgtctcactctgaagcaatacaggaaagccctttctgcggtgctgttgatgataatagtccacaattctattctgcatcatcaaaaggagctagttccaagagaagccccttcactcctgctaagagtgatggcactagaagctacctaagtggttactcagaccatccaaattacatgtcttacactgaatcgtcaaaagctaaggtaaggtctttcagtgctccaaaacaaaggcctcattatgaaagatctagttcaacaaagaggtactccattcatggttttggtgaattgaaatcaactacacaaaggtctgccatgcatgcaaacttcgccagcaaagcttaccccggttcgggtaggttggacaggctaggaatgccccttgggtatagatactaaataatggttttaccatttggctaaggaatgttatgtagtttatgtttagatgttaacgatgatgactctcacctaccctaatgtatccatcctttaatgttttagtgcatgtgagttcccaagttaaaaagaatagtagctgctttacaagaagttaaattagaaaaaaaaaaaaaaaaaaaa

SEQ ID NO: 76 - protein, 300 aa, Gossypium hirsutum
  misc_feature: Ceres CLONE ID no.1920115
  misc_feature: Score of 34.2 for HMM of FIGURE 2.
  misc_feature: Functional Homolog Of Ceres SEEDLINE ID no. ME06748 at SEQ ID NO. 41
MQALLRAQARARAGRAQISESSQSSCKSSHFHHPDPATPEKFEHVIRSKGTKYEQSSMLKRNGSKSSGRTVDNQEKLHSGWYRRVDEQTWEHSTRIGPNDDEKNDKILEVDTGKPNFISKRRNLFHSTHLSLNSDLYSCSFTNSRDSHQTAPSPSSGEVQSLTPLMLSHSEAIQESPFCGAVDDNSPQFYSASSKGASSKRSPFTPAKSDGTRSYLSGYSDHPNYMSYTESSKAKVRSFSAPKQRPHYERSSSTKRYSIHGFGELKSTTQRSAMHANFASKAYPGSGRLDRLGMPLGYRY

SEQ ID NO: 77 - DNA, 1614 bp, Arabidopsis thaliana
  misc_feature: Ceres CLONE ID no.21821
  misc_feature: Encodes the peptide sequence at SEQ ID NO 78
ataatttgatgaacagtcttcttctctgatgcagaaaccctctccctgaatcttgattctctcacaatcaagatttgaagcaaacgttttgagaaaaatcttttgacaccatcaaatttggttggcggattgtgggaggaattccagagcaatatagcaggtgatggttgtacaacaatggctaagaagaagggcttgttcactgtattgaaaaggatttttatttcagaagttaattcagaaaagaaagagaagagaagaaaatggacattttggaagcttaggattaagaaaagattaccttccattacagcacctccagagcacaggacaagtcatgaatcgcatgaggaacagaaggaggaaattgtgtcagatgtgggtgagatcagccaagtgtcttgtagtcgacagttagattccatagaagagtcaaaaggttcaacatcaccagaaactgctgatctggtagtccagtatcaaatgtttcttaatagacaggaagaagttcttgctgctactcgcattcagaccgcctttcggggtcatcttgcaaggaaagctctacgtgccttgaagggaatagtgaagctccaagcatatatcagaggtcgtgctgtgagacgccaagcaatgactacactaaaatgcctgcaatctgttgtgaacattcagtcacaagtctgtggtaagagaacacagattcccggaggtgttcacagagattatgaagagagcaatatattcaatgataacattctcaaggtggacacaaacggtcaaaagagatgggacgatagtcttttaacaaaggaagaaaaggaagcagtggtaatgagcaagaaagaagcttcactaagaagagaaaggataaaggaatatgcagtcacccaccggaaatctgcggagtcataccagaaacgaagtaacactaaatggaagtactggttagacgaatgggtagatacacaactaaccaagagcaaggagctcgaagatctcgacttctcttcgaaaacaaaaccgaaagacgaaactttgaacgagaagcagcttaaaactccaaggaactcatcaccaagaagattagtgaataatcatagaagacaagtttcaataggtgaagatgaacaaagccctgccgcggtcactatcactacaccaacttatatggttgcaacagagtcagcaaaggcaaagtcaagatcattaagctccccaaggataagaccgagaagttttgacacacagtcagagagttactcgccatataagaacaagctatgcctgacgacatcaatgatgagtgaagcaccaagcaaagtaaggattgccaacaatggcagtaacactagaccaagtgcataccagcaacggtctccagggttaaggggatttaacataggccctttgaaatcatgcaataataataatactctattgaacgatctcagcattaattcagaaagatctctacctagctggaacaagcagagcagcttgagatgagtggatattgaaccctgtatatatacatactacatacgttccaatgtttcttttgacttttgagggtcacactcacatatgtgtatcatcaaatattgtttcgtt

SEQ ID NO: 78 - protein, 443 aa, Arabidopsis thaliana
  misc_feature: Ceres CLONE ID no.21821
  misc_feature: Score of 237.2 for HMM of FIGURE 2.
  misc_feature: Functional Homolog Of Ceres SEEDLINE ID no. ME06748 at SEQ ID NO. 41
  misc_feature (111)..(131): Pfam Name: IQ Pfam Description: IQ calmodulin-binding motif
MAKKKGLFTVLKRIFISEVNSEKKEKRRKWTFWKLRIKKRLPSITAPPEHRTSHESHEEQKEEIVSDVGEISQVSCSRQLDSIEESKGSTSPETADLVVQYQMFLNRQEEVLAATRIQTAFRGHLARKALRALKGIVKLQAYIRGRAVRRQAMTTLKCLQSVVNIQSQVCGKRTQIPGGVHRDYEESNIFNDNILKVDTNGQKRWDDSLLTKEEKEAVVMSKKEASLRRERIKEYAVTHRKSAESYQKRSNTKWKYWLDEWVDTQLTKSKELEDLDFSSKTKPKDETLNEKQLKTPRNSSPRRLVNNHRRQVSIGEDEQSPAAVTITTPTYMVATESAKAKSRSLSSPRIRPRSFDTQSESYSPYKNKLCLTTSMMSEAPSKVRIANNGSNTRPSAYQQRSPGLRGFNIGPLKSCNNNNTLLNDLSINSERSLPSWNKQSSLR

SEQ ID NO: 79 - DNA, 1689 bp, Glycine max
  misc_feature: Ceres CLONE ID no.560066
  misc_feature: Encodes the peptide sequence at SEQ ID NO 80
ttttttatgggatttgaaaaaatggatcacagacattgaagttgacctatgtgttgatattcttaaatggccaaaaagaagagctggtttagtctggtgaagaggctctttatatgggacacacattccacacaagataagaaggagaaaagaaggaaatggatatttggaaggctaaagagcaagagattgccttcaattaaagctccactaccctcaaaaggaacaacactaagtgaggcagagcaagaacagagcaagcatgctttaacagtggccattgcctcagcagcagctgctgaagctgctgttactgctgctcatgctgctgctgaggttgttcgcctcactgggcaacgcaacgaaaactcagaagaatctcaacctgttaaaactaggaatggtgctccacaatccacataccagtgccagagggagattaaagaatctgctgcagccatcaaaattcaaactgcatttcggggttacctggcaaggaaggctttgagggcgttgaagggaatagtgaagcttcaagctatcattcgtggcagagccgtaagacgccaagctatgagtagtcttaagtgcttacagtccattgtgagcatccagtcacaggtctgtgcaaggaggctccaaatggttgaagggagatgtgattactctgaaaatgaagagatgcaagattttaaagacaaaataattaggatggactcaaacagtgaaagaaagtgggatgaaagcactgtattgaaggaagaggtagacacctcttgcacaagcaagagagaaagaacaaaagaatactcatttaaccacagaaggtcagcagagtcagaaagaagtaaagtaaatggaagatggaggtactggctagagcagtgggtagatacacaactttcaaagagtaaagagcttgaagatttagactcagtttttagctcacattctagagctggggaggaatatggaggaaggcaacttaagctgagaagtaatattcagagacaaaatccagttgaaggattggattctccaatacttggttcaagaagatcttttcctcataggaggcagtgttcagtgggagaggaccactcatttttaagctctcctgcaactccagcatacatggctgcaacagaatcagcaaaagcaaaagcaagatcaacaagctccccaaaaataaggactggggggaatgtggacatgaactctgatagctattcaccatgcaagaaaaagctatccattgcatcttctattaacagtgaaatgcttagtaatggtagggtgggcaagctcagtgttaaccagcagcaaagatcaccaagctttaagggactttcagtgcctataaaatcaagccgaacaactatcaaggatctcagtattaattcagattgctcactccctaattgggatcgacaggctttcttcaaatgaatctatgaatgctgatgttactctttcttgcattaacacaattccttgtatcatgtgaaggcttggaaacaataactgtttataaatatgtatgatatactatatgctattggatgttattttggttgggaattgaacattaatgtgacagaaaatagttattctggagatataagatgaattgtatgattaagaaagaagagatataagatggattgtatgattaagaaagaaggaaag

SEQ ID NO: 80 - protein, 460 aa, Glycine max; identical to SEQ ID NO: 44
  misc_feature: Ceres CLONE ID no.560066
  misc_feature: Score of 822.2 for HMM of FIGURE 2.
  misc_feature: Functional Homolog Of Ceres SEEDLINE ID no. ME06748 at SEQ ID NO. 41
  misc_feature (128)..(148): Pfam Name: IQ Pfam Description: IQ calmodulin-binding motif

SEQ ID NO: 81 - protein, 501 aa, Oryza sativa subsp. japonica
  misc_feature: Public GI ID no.115453071
  misc_feature: Score of 546.0 for HMM of FIGURE 2.
  misc_feature: Functional Homolog Of Ceres SEEDLINE ID no. ME06748 at SEQ ID NO. 41
  misc_feature (122)..(142): Pfam Name: IQ Pfam Description: IQ calmodulin-binding motif
MERKRRGWLERIKRLFVSEPKQKPKPDKKVKSKRWMFAGKLKTQHSFALPAPAPAVEEEQIRQAEDEQSKHAMAVALATAAAAEAAVAAAHAAAEVVRLTGKTAALAPAPATTTTPTPYGHEHAALMIQSVYRGYLARRALRALKGLVRLQALIRGQAVRRQTAATLRGLESLMKIQARQRARASSAAAAGGDHNAANSPAPDGMDALLRRGRELYYAAAAAVHEQQLSKGWDSSTLSKEEMSAMSRSREEAALKRVRALQYASLHQSEKVGVRRQPMSREEMETLNQRWSWLEEWVGSQPPFDKDIPVAHQSPSRDAAGAAMNDDERPPPPPVLRSRSRADRLACVGGDDDDADRQLGYSARRSFTRAGRRTPARDDDGGGAAAFPGYMASTASAKAKFRSMSTPKERSGAGAADAYSEQCFPFADRLLSPIPSMSPIPSIASDIVFARSSRPAAAQRSPRVKGPMTPTRSRSRRSPGRHSFGSEAALHQLQMEQYTPIR

SEQ ID NO: 82 - DNA, 1814 bp, Gossypium hirsutum
  misc_feature: Ceres CLONE ID no.1968211
  misc_feature: Encodes the peptide sequence at SEQ ID NO 83
aatttcccccttcctctctccctcctttcctcagtaagcttacgaaacttcttcttcgcttcttctctgcaaatgaatcccgagaaacctcccaaacccttatctttttaccctttttcaccttcttctccatcaccaaactaacgtttccgtacacaacgaacaaaatcaaagcaatgggtaaagcttccaagtggttccgcagcatcctcggcttcaaaaaatccgacccccataaccaaccttctccttcttcttcaaaaccaacttcccataaagacaaacggcgttggagtttcgtcaaatcgtaccgtgaaaaagactcctccacgaacaatagtaatgcgaagttgccgtcgtcttcgcagcaacagaaagactctgtttccttcgttgaaaggaaaggtgacaatgaagtaacggatcctagcaagcacgccatcgctgttgctgccgctactgccgccgttgccgaagcagccgttgcggctgctcaagctgccgctgcggtggttaggctcactagtaacagtggtaggtgcgcgcgtgaatcggcagcggtttacgtttgcaacaacaatagctatatagcacacgatgagtcatccgccattaagatacaatctgcatttcgtggatacctggcaagaagagcattgcgagcactaaaaggattagtgagactccaagcattggttagaggtcatatagaaaggaagagaactgcagaatggttaagaaggatgcaagcattattgagagcacaagcacgtgctcgtgctggccgggcccaaatttccgagtcttcccaatcaagctgcaaatcgtctcacttccatcatccggatccagcaacccctgaaaaatttgaacatgttattcgatccaagggtacaaaatatgaacaatcatcaatgttgaagagaaatggatcaaagtcaagtggaaggactgttgataatcaagagaaattacactcaggttggtatcgccgtgttgatgagcaaacatgggagcattcaacaagaattggtcctaatgatgatgaaaagaatgacaaaatccttgaagttgacactgggaaaccaaatttcatctctaaacggagaaacctctttcattcaacacatctttctctgaattctgatttatatagctgtagtttcactaattcgagagactcacaccaaacagctcctagtccttcatctggtgaagttcagtctttaactccattgatgctgtctcactctgaagcaatacaggaaagccctttctgcggtgctgttgatgataatagtccacaattctattctgcatcatcaaaaggagctagttccaagagaagccccttcactcctgctaagagtgatggcactagaagctacctaagtggttactcagaccatccaaattacatgtcttacactgaatcgtcaaaagctaaggtaaggtctttcagtgctccaaaacaaaggcctcattatgaaagatctagttcaacaaagaggtactccattcatggttttggtgaattgaaatcaactacacaaaggtctgccatgcatgcaaacttcgccagcaaagcttaccccggttcgggtaggttggacaggctaggaatgccccttgggtatagatactaaataatggttttaccatttggctaaggaatgttatgtagtttatgtttagatgttaacgatgatgactctcacctaccctaatgtatccatcctttaatgttttagtgcatgtgagttcccaagttaaaaagaatagtagctgctttacaaaaaaaaaaaaaaaaaaaa

SEQ ID NO: 83 - protein, 489 aa, Gossypium hirsutum
  misc_feature: Ceres CLONE ID no.1968211
  misc_feature: Score of 555.8 for HMM of FIGURE 2.
  misc_feature: Functional Homolog Of Ceres SEEDLINE ID no. ME06748 at SEQ ID NO. 41
  misc_feature (142)..(162): Pfam Name: IQ Pfam Description: IQ calmodulin-binding motif
MGKASKWFRSILGFKKSDPHNQPSPSSSKPTSHKDKRRWSFVKSYREKDSSTNNSNAKLPSSSQQQKDSVSFVERKGDNEVTDPSKHAIAVAAATAAVAEAAVAAAQAAAAVVRLTSNSGRCARESAAVYVCNNNSYIAHDESSAIKIQSAFRGYLARRALRALKGLVRLQALVRGHIERKRTAEWLRRMQALLRAQARARAGRAQISESSQSSCKSSHFHHPDPATPEKFEHVIRSKGTKYEQSSMLKRNGSKSSGRTVDNQEKLHSGWYRRVDEQTWEHSTRIGPNDDEKNDKILEVDTGKPNFISKRRNLFHSTHLSLNSDLYSCSFTNSRDSHQTAPSPSSGEVQSLTPLMLSHSEAIQESPFCGAVDDNSPQFYSASSKGASSKRSPFTPAKSDGTRSYLSGYSDHPNYMSYTESSKAKVRSFSAPKQRPHYERSSSTKRYSIHGFGELKSTTQRSAMHANFASKAYPGSGRLDRLGMPLGYRY

SEQ ID NO: 84 - protein, 464 aa, Oryza sativa subsp. indica
  misc_feature: Public GI ID no.116310011
  misc_feature: Score of 886.7 for HMM of FIGURE 2.
  misc_feature: Functional Homolog Of Ceres SEEDLINE ID no. ME06748 at SEQ ID NO. 41
  misc_feature (124)..(144): Pfam Name: IQ Pfam Description: IQ calmodulin-binding motif
MGWASRWLRGLLGGGKKPNSGSGDPKPAREKKRWGFGKSFREKSPAHPPPPPPPSAAVQRAVTPRRAYTASDEGDDEQSKRAIAVAAATAAVAEAAVAAAQAAAAVVRLTSSGRCAPAAAKREEYAAVRIQAAFRGYLARRALKALRGLVKLQALVRGNIVRRQAAETLRCMHALVRVQRRARACRAIRSQHVSAHPGPPTPEKYDQATHEGVPKHGRSGSLKGSSSKTPGSERLTRERSESCGRNWLDKWVEERYLDDEKNAKILEVDTGKPGRHASRRRSGSHHHHSSCSSMTSEQKSRSYATMPESPSKDSTTAQQSVPSPPSVGMAEALSPLRMAVDIAELCDSPQFFSATSRPGSSRSRAFTPTKSECSRSLFGGYSDYPNYMANTESFRAKARSQSAPKQRPQYEKSSSLRKASAHAFGPGSCAPVAQRTTASLHSKFTNKAYPGSGRLDRLGMPVKY

SEQ ID NO: 85 - DNA, 1019 bp, Arabidopsis thaliana
  misc_feature: Ceres SEEDLINE ID no.ME08768
  misc_feature: Encodes the peptide sequence at SEQ ID NO. 86
gttactaatctcacgcacattctttctctctctaaattctgcaccacaatccgcaaaatgaccaaatacttcttgctgtgaatgtcgaaaatgcctgcaggcacaacatgtgaagtgatgcaaaacggcaacacttgtttcaccagatcctttcgtcattgatggggaagaaaggaggcagctggttctcatctgtgaagaaagttttcaagtcatcttctaaagattcgccccagcctgagaagaagaaggacaacacacagaaattacagcatgaagtggcagaggtggtgtcctttgagcattttcctgcagagagttctccagataatgtgagcaatgcagagatgagtacgacatcaacgccagtgaccaacgaagatagaagccatgcgattgccgttgcagcagcaactgccgcagctgcagaagctgctgtggtggctgctcaagcagctgcaagagttgtaagattggcaggaagttacgggcggcagtccaaggaagaaagagcagcaacactcattcaatcatactatagaggctacctggctcgacgtgcactacgagcattgaagggattagtgaggctgcaagcactggtgaggggacacaatgtgcggaagcaagcgcagatgacgatgcggtgcatgcaagcactggtgagggtgcaggcacgagtacgggctcgccgattccaattgagtcacgcggatcaggaaagagagaagaaagaagagcccaagcccatacccgtgcccgtgcccatgagccccctgagaagaatagacgacattaatgactgggacaataggcgtcaaagtagctacaaaattaaggaaaacgatttgcggaaacatgaagctgtaatgaagagagagagagctcttgcatacgctttcaactatcaacaggttagttaatttgtcatgattaaatgggaatatagtggataaaatagcttagtctaatattctttcaaaacggtacgtgcaatttaatttatctatatcttcttt

SEQ ID NO: 86 - protein, 253 aa, Arabidopsis thaliana
  misc_feature: Ceres SEEDLINE ID no.ME08768
  misc_feature: Score of 467.7 for HMM of FIGURE 1.
  misc_feature (116)..(136): Pfam Name: IQ Pfam Description: IQ calmodulin-binding motif
MGKKGGSWFSSVKKVFKSSSKDSPQPEKKKDNTQKLQHEVAEVVSFEHFPAESSPDNVSNAEMSTTSTPVTNEDRSHAIAVAAATAAAAEAAVVAAQAAARVVRLAGSYGRQSKEERAATLIQSYYRGYLARRALRALKGLVRLQALVRGHNVRKQAQMTMRCMQALVRVQARVRARRFQLSHADQEREKKEEPKPIPVPVPMSPLRRIDDINDWDNRRQSSYKIKENDLRKHEAVMKRERALAYAFNYQQVS

SEQ ID NO: 87 - DNA, 1906 bp, Gossypium hirsutum
  misc_feature: Ceres CLONE ID no.1943807
  misc_feature: Encodes the peptide sequence at SEQ ID NO 88
atcttttttatcttcacagtgttggtgtcttggctccttcttcaaagcttcttttagctgtaaatgtagcttggtttaaccctatccttttgaatggggatgaaaggagggacttcatggttgactgctgtgaaaagggcttttagatctcctactaaagatacccatgaagatgaaaaggtaagtgtttcaatctattttaatggctgtttatgaatctaaaaagaaaaccctttgatttttttttatatagaagagagataaacggaggtggatctttaggaaacaaaatacaagtcctgtgaagagtgtaggtaataatggtggtggtggtgcaagtacggcagcagcggagcaaagacatgctattgctgtggcggtggctaaagcagctgaagctgaagctgcggtggcgacggcacaagcagctttacaagctgctcggttgactaaacctagttatggcaggaaacatcactttgctgctattgttattcagacagcttttagaggctacctggccaggagagctctacgtgcgttaaaagggctagtgaagttacaagctttagtgagaggtcacaacgtgagaaagcaagccaagatgacgcttcgttgcatgcaagcactggttaaagttcagtctcgtgttttagaccaaagaatgaggctctcgcacgatggttgcagccggaaatcagcatttagcgacaccaacagtgtatgggaatcacggtatcttcaagatatatcggatagaagatcattatcgagagaaggaagtagcatagcagatgattgggacgaaaggccacacacagttgaagaagtgaaagctatgttacaacataggaaagaagctgctttgaaacgtgaaaagagcttgtcacaagcactgtcacaacagatgaggagagctcgaaggagtccatcaatggggggacaagatgagtggcttgatcgttggatgcctgctaaaccatgggataacagaggaagagcttcaatggatcaaagagataatgtcaaaactgttgaaatggacacttcacagccttattcatatttagcaccaaattatagaagaacaaattcaaaccattatcaccaaaggcctagttcacctctccatagggctcaacacaatgcacaacctttccacccttctccaattacaccctctccatcgaaaacacgtccggttcaagtacggtccgcgagccctcgttgcgttagggaagaccgaacatcgttttcatcatcacaaacaccaagtttaaggtccaattattattacacaggaagggttagtactcaagctagtactagcataaacaatgctactacattgcctaattacatggcagcaacagagtctgcaaaggctaggattaggtctcaaagtgcaccaagacagaggccatcgacaccagagagggaccgaatcggttcagcaaggaaaaggctatcgtttcccgtcccggaaccatatggtatcgggatggggtacggaggttatggtcatagcttgaggagcccgagttttaaaagtgtaagcgggtcgcaattcggattggaacgacagtctaactattcatcttgttgtactgagagccttggtggtgaaatgtcaccatcttcaactagtgatctaagaaggtggttgaggtgatcccatcaatgtagctgttggtttttactagttttatagtgtgtttccattgttgattttaccaattcttggttgaaattcaagctttataagtgaggcaactgcgatgaacccttccttactgggatctttcatgagattcataaccaaattgagtgtgtaatactataaagtaactctgtaattctgttttgtcataactttttaatatattaaagcttatcatcttttccg

SEQ ID NO: 88 - protein, 355 aa, Gossypium hirsutum
  misc_feature: Ceres CLONE ID no.1943807
  misc_feature: Score of 667.2 for HMM of FIGURE 1.
  misc_feature: Functional Homolog Of Ceres SEEDLINE ID no. ME08768 at SEQ ID NO. 86
MTLRCMQALVKVQSRVLDQRMRLSHDGCSRKSAFSDTNSVWESRYLQDISDRRSLSREGSSIADDWDERPHTVEEVKAMLQHRKEAALKREKSLSQALSQQMRRARRSPSMGGQDEWLDRWMPAKPWDNRGRASMDQRDNVKTVEMDTSQPYSYLAPNYRRTNSNHYHQRPSSPLHRAQHNAQPFHPSPITPSPSKTRPVQVRSASPRCVREDRTSFSSSQTPSLRSNYYYTGRVSTQASTSINNATTLPNYMAATESAKARIRSQSAPRQRPSTPERDRIGSARKRLSFPVPEPYGIGMGYGGYGHSLRSPSFKSVSGSQFGLERQSNYSSCCTESLGGEMSPSSTSDLRRWLR

SEQ ID NO: 89 - DNA, 1677 bp, Populus balsamifera subsp. trichocarpa
  misc_feature: Ceres ANNOT ID no.1471392
  misc_feature: Encodes the peptide sequence at SEQ ID NO 90
atggggaagaagggaggtagctcatggttgaccgttgtgaaaagggcttttagatctcctaataaagaaaatgacaagagaactgctgggactacaggccatgaccaagaagaagatgaagaaaagaagagagagaagaggaggtggctgtttaggaaacctacgaatcaagaaacagtgacacaacagatcctatcaaaggcaggaaatgtcaaggcctccacgggtggtggtggaggtgcaccgacagaccatgtgtcggcagctgcagcagctgagcaaaggcatgcaattgctgtagctgttgccactgcagctgcagctgaaactgcattagccactgcccaggcggccgtggaggtggctaggctcactaggccttcttatcaccctagagaacgttccgctgccattgtcattcaaaccgcttttagaggatacctggcaaggcgggctcttcgcgcgcttaaagggctagtgaagttgcaagctttagtgaggggacacaatgtgagaaagcaggccaagatgaccctgagatgcatgcaagctctggttcgagtgcaggctcgagtacttgaccaacgcatgaggctttcacatgaaggcagcagggaatctgcattcagtgacaccaatagcgtgtttgaatcgcgatatcttcaagaaatttcagaaagaaagtcgatgtcaagagacggcagcagcattgcagatgattgggatgatcggccacgcacaattgaggaagtcaaggccatgttgcaacgcaggaaagaagttgcattcaagcgtgagaaggccttatctcaaggtttctctcaacagatatggagaaaccgtaggagcccatcaatgggcaatgaaggtgagctccaagaaagatcacaatggcttgatcattggatgcctgcaaagccgtgggacaatagcagcagagcacgagcctcaactgatcaaagaaaccccatcaaaactgtagaaattgaaacctcccaaccttgctcatatttagctcctaattttggaagaacgaaccaaaaccaatatcaccaacaccagagatccaattcaataaacaatggtgttacatgctcggctcctcctccactccatagagctcatcaaaatgcttctctccgcaactctcctattacaccctccccgtcaagaactaggcctcttcaggttcgttcagcgagtccccgatgtgctagagaagatagaagctgtaattcctctcgaacaccgagtttaaggtccaattacctctataatggcaatctgaaacaacatggaatcaggggtggtgctgctagtgttagtggaaatgctaatgctacattgccaaattacatggctacaactgagtccgccaaggctagattgagatcacagagtgcgccaaggcaaagaccatcaacaccagagcgagacagggttgggtctgcaagaaaacggcttttgtatcctgtccccgacccttacggtgtcgggatgggttatggtggtgttggttacgggcatggtttcaggagtcccagctttaaaagtgtaagtggttcacattttggtggattagaacaacaatctaactattcttcttgctgcactgataccttcggtgctgagatttccccttcttcaacgagcgaccagagaaggtggttgagataa

SEQ ID NO: 90 - protein, 382 aa, Populus balsamifera subsp. trichocarpa
  misc_feature: Ceres ANNOT ID no.1471392
  misc_feature: Score of 422.0 for HMM of FIGURE 1.
  misc_feature: Functional Homolog Of Ceres SEEDLINE ID no. ME08768 at SEQ ID NO. 86
MTLRCMQALVRVQARVLDQRMRLSHEGSRESAFSDTNSVFESRYLQEISERKSMSRDGSSIADDWDDRPRTIEEVKAMLQRRKEVAFKREKALSQGFSQQIWRNRRSPSMGNEGELQERSQWLDHWMPAKPWDNSSRARASTDQRNPIKTVEIETSQPCSYLAPNFGRTNQNQYHQHQRSNSINNGVTCSAPPPLHRAHQNASLRNSPITPSPSRTRPLQVRSASPRCAREDRSCNSSRTPSLRSNYLYNGNLKQHGIRGGAASVSGNANATLPNYMATTESAKARLRSQSAPRQRPSTPERDRVGSARKRLLYPVPDPYGVGMGYGGVGYGHGFRSPSFKSVSGSHFGGLEQQSNYSSCCTDTFGAEISPSSTSDQRRWLR

SEQ ID NO: 91 - protein, 527 aa, Arabidopsis thaliana
  misc_feature: Public GI ID no.6715635
  misc_feature: Score of 916.5 for HMM of FIGURE 1.
  misc_feature: Functional Homolog Of Ceres SEEDLINE ID no. ME08768 at SEQ ID NO. 86
  misc_feature (121)..(141): Pfam Name: IQ Pfam Description: IQ calmodulin-binding motif
MGKKNGSSSWLTAVKRAFRSPTKKDHSNDVEEDEEKKREKRRWFRKPATQESPVKSSGISPPAPQEDSLNVNSKPSPETAPSYATTTPPSNAGKPPSAVVPIATSASKTLAPRRIYYARENYAAVVIQTSFRGYLARRALRALKGLVKLQALVRGHNVRKQAKMTLRCMQALVRVQSRVLDQRKRLSHDGSRKSAFSDSHAVFESRYLQDLSDRQSMSREGSSAAEDWDDRPHTIDAVKVMLQRRRDTALRHDKTNLSQAFSQKMWRTVGNQSTEGHHEVELEEERPKWLDRWMATRPWDKRASSRASVDQRVSVKTVEIDTSQPYSRTGAGSPSRGQRPSSPSRTSHHYQSRNNFSATPSPAKSRPILIRSASPRCQRDPREDRDRAAYSYTSNTPSLRSNYSFTARSGCSISTTMVNNASLLPNYMASTESAKARIRSHSAPRQRPSTPERDRAGLVKKRLSYPVPPPAEYEDNNSLRSPSFKSVAGSHFGGMLEQQSNYSSCCTESNGVEISPASTSDFRNWLR

SEQ ID NO: 92 - DNA, 1946 bp, Triticum aestivum
  misc_feature: Ceres CLONE ID no.910109
  misc_feature: Encodes the peptide sequence at SEQ ID NO 93
atcaaaccccccactgcccgcgccagccagccgcggcaataataataactccgccgcctcctgccatgccgcacgctagtagtagcacgctaggatcgagtagctcgtagcgtagccgtgcgagggagggaggtgggtcgatgcccgcggccgtgcaaccacagcaaccgcgagccggtggtgttggccatggggaataagaagggcgggtcgtcgtggctcaccgccgtcaagcgggccttccgctcgccgtccaaggaggacagccccaagaagtctgcacgcctccgcgaggaccctgacgccgacgaggacaagaccaagagggagaggaggagatggctcttcaggagatcctcgtccccgtctccgtctccggcgtctgcccccgcgccgccggagcagcagcagtcggcgtcgaggtcggcacctgcacccgctgtgacggacgagcagcgtcacgccatcgcgctggccgtggcgaccgcggcgacggccgaggctgccgtggccacggcgcaggcggcggccgaggtcgtccgcctgacccgcccctcctccagcttcgtgcgggagcactacgctgccatcgtcgtacagaccgccttccgaggctacctggcgaggcgtgctctgcgcgcgctcaaggggctggtgaagctgcaagcgctagtgcgcgggcacaacgtgcggaagcaggccaacatgacgctgcggtgcatgcaggcgctggtgcgcgtccaggcgcgggtgcgcgaccagcggctgcgactctcccaggagtccttgtccgccgccggtgcggctgcgtgcggcagcagcaaatcctcgtacagcgttgacacctccgctttctgggactccaagtacacccaagaatacgccgaacgccgctctgtggagcggtcgcgagacggcagcagcttcgccgccgaagactgggacgaccggccgcggacgatagaggagattcaggcgatgctgcagacgaggaaagacgctgctctcaagcgtgagagagcgctctcatacgccttttctcaccaaatttggaggaacgccgctccgtcagtcgaggaggagatgaacgtcgacgggcagccgcgctgggcggagaagtggatggcgtcgcgcgcgtcgtttgatacaaacaggagcagcgcccgaactgccgcggcggcggctgctgcggcaccagggcgcgcgtccacggaccaccgcgaccaggtcaagacgttggagatcgacaccgcacggccattctcctactccacgcctcgccggcatgccccaccgtcgcagcacgggaacggctcgccgatgcaccgtgcgcaccaccaggcttcggtcacgccgtcaccggggaaggcgaggccaccgattcaggtgcgctccgcgagcccgcgagtggagcgcggcacaagtggtggaggaggaagctacacaccgagcttgcactcccagcgccacgcgtcctccggctcggcggtgccgaactacatggcggccacggaatctgcaaaggcacgtatccgctcccagagcgcgccacggcaacgccctgcaaccccggagcgcgaccggccacagaccgcctataaccccgccggagggagcgccaagaagcggctgtcgttccccgtcccgcaggacccgtacggcgttgggtacgcgcagagcctgcggagcccgagcttcaagagcgcgacggggcggttcacctccgagcagcgttcgaccgtctcgtctctgtcgtgcgcagagagcgtcggcggggaaccagtctccccgtcgtccaccactgacctccgccgctggctccgttgagttgagcccccggcgaggtgttcgttgtaatacctgcgttgctaattttctcgtaatctcctcggagaaaaatgaccttctcgtaatctatttttttgctgctaaaaaaaaaaaaaaaa

SEQ ID NO: 93 - protein, 543 aa, Triticum aestivum
  misc_feature: Ceres CLONE ID no.910109
  misc_feature: Score of 1259.0 for HMM of FIGURE 1.
  misc_feature: Functional Homolog Of Ceres SEEDLINE ID no. ME08768 at SEQ ID NO. 86
  misc_feature (130)..(150): Pfam Name: IQ Pfam Description: IQ calmodulin-binding motif
MGKKAGTTSSWLTAVKRAFRSPSKDDSPNKAARLRDDTDDDKGKRERRRWLFRKSSSPSPAPPTPPPPQQQQQQSRAAAVTEEQRHAIALAVATAATAEAAVATAQAAAEVVRLTRPSSSFVREHYAAIVVQTAFRGYLARRALRALKGLVKLQALVRGHNVRKQANMTLRCMQALVRVQARVRDQRMRLSQDSISLSAAAASAAPCGSSKSSYSVDTSTFWDSKYTHDFAAADRRSIERSRDGSSFAAGDDWDDRPRTIEEIQAMLQTRKDAALKRERALSYAFSHQIWRNPAPSVEEMDVDGQPRWAERWMASRASFDTSRSTVRASAAAAPGRASTDHRDQVKTLEIDTARPFSYSTPRRHGNASYHASSSPMHRAHHHSPVTPSPSKARPPIQVRSASPRVERGGGGGGSYTPSLHSHRHHASSGGAAAVPNYMAATESAKARVRSQSAPRQRPATPERDRMSFGGGGGGGGAKKRLSFPVPIDPYGAYAQSLRSPSFKSAAGRFSSEQRSNVSSSCAESLGGDVVSPSSTTDLRRWLR

SEQ ID NO: 94 - protein, 543 aa, Oryza sativa subsp. japonica; identical to SEQ ID NO: 93
  misc_feature: Public GI ID no.115474509
  misc_feature: Score of 1167.6 for HMM of FIGURE 1.
  misc_feature: Functional Homolog Of Ceres SEEDLINE ID no. ME08768 at SEQ ID NO. 86
  misc_feature (125)..(145): Pfam Name: IQ Pfam Description: IQ calmodulin-binding motif

SEQ ID NO: 95 - DNA, 1812 bp, Panicum virgatum
  misc_feature: Ceres CLONE ID no.1780908
  misc_feature: Encodes the peptide sequence at SEQ ID NO 96
gtgaccagccagccatggagcgcggccaacgccccccgcgccagcaataatacaacccccccaccacccgggccgcgcctgcccgtcgccggacatgggcaagaagggcggcgccacgtcctgactcaccgccgtcaagcgggccttccgctcgccctccaaggacgacgccgcctcgcccgcaaggaaggcctcgcgcctccgcgaccgcgacgacgcccccgccgacgccgaccaagacaagcaggggaagcgggagcagcgccggcgatggctgttccggaggtcctcctccccgtccccgtcccctgcccccgccgcgccggagcacccggccgtcacggaggagcagcgccacgccatcgcgctggcgctggcgaccgccgccacggccgaggccgccgtggccacggcgcaggcggcggcggaggtggtccgcctcaccctccccggcggcctcgccgcccgcgagcactacgccgccgtcctcatccagaccgccttccggggctacctggcgcgccgcgcgctgcgggcgctcaggggcctcgtcaagctgcaaacgctcgtgcgcggccacaacgtccgcaagcaggccaacatgacgctccgctgcatgcaggcgctggtgcgcgtccaggcgcgcgtccgggaccagcggatgcgcctctcccaggactccatgtccctgtccatgccgctgtccgccgccggcgccgccgcggcgccgtgcggcagcagcaagtcgtcgtacagcgtcgacacatccacgttctgggactccaagtacacccacgactacgccgaccgccgctccgtcgagcggtcgcgcgacggcagcagcttcgccgccgacgactgggacgaccggccgcggacgatagaggagatccaggccatgctgcagacgaggaaggacgcggcgctcaagcgtgagagggcgctgtcctacgccttctcgcatcaactttggaggaacccggcgccggcggcggatgagatggacgtggacggcggcgggcagcagccgcggtggatgacgtcgcgcgcgtccttcgacacgaaccggagcagcagcatccgcggcgcggcggtgcccgggcgcgcgtccatggaccaccgcgagcccgtgaagacgctggggatggacacggcgcggcccttctcgtactcgacgccgcggcagcaggcgccgtcgtcctcgccgatgcaccaccgcgggcactcgccggtgacgccgtcgccggggaaggcgcggcccccgatccaggtccggtcggcgagcccgcgcgtggaccgcggcgcgggcggcgggagctacacgccgagcctgctgcactcccagcggcaccaccaccaccaggcgggggcggcggtgcccaactacatggcggcgacggagtcggccaaggcccgggtgcggtcccagagcgcgccgcggcagcggcccgcgacgcccgagcgcgaccggctctccggcggcggcgggagcgcgaagaagcggctgtcgttcccggcggcggcagaggcgtacgcgcagtccctgcggagcccgagcttcaagagcgcggcggggcggttctcgtcggagcagcggtcgacggtgtcgtcgtcgtgcgcggagagcctcggcggagagccggcgtcgccgtcgtccaccaccgacctccgccgctggctccgctgagggccggccggccgtccgttctccgttgtagcagtaacgccgccttttggctcggcagacacgaccacgtgcccctgtagcatcatcttctctctcggtgtaattcatggcagcttttttcgagc

SEQ ID NO: 96 - protein, 361 aa, Panicum virgatum
  misc_feature: Ceres CLONE ID no.1780908
  misc_feature: Score of 598.0 for HMM of FIGURE 1.
  misc_feature: Functional Homolog Of Ceres SEEDLINE ID no. ME08768 at SEQ ID NO. 86
MTLRCMQALVRVQARVRDQRMRLSQDSMSLSMPLSAAGAAAAPCGSSKSSYSVDTSTFWDSKYTHDYADRRSVERSRDGSSFAADDWDDRPRTIEEIQAMLQTRKDAALKRERALSYAFSHQLWRNPAPAADEMDVDGGGQQPRWMTSRASFDTNRSSSIRGAAVPGRASMDHREPVKTLGMDTARPFSYSTPRQQAPSSSPMHHRGHSPVTPSPGKARPPIQVRSASPRVDRGAGGGSYTPSLLHSQRHHHHQAGAAVPNYMAATESAKARVRSQSAPRQRPATPERDRLSGGGGSAKKRLSFPAAAEAYAQSLRSPSFKSAAGRFSSEQRSTVSSSCAESLGGEPASPSSTTDLRRWLR

SEQ ID NO: 97 - DNA, 1398 bp, Populus balsamifera subsp. trichocarpa
  misc_feature: Ceres ANNOT ID no.1520883
  misc_feature: Encodes the peptide sequence at SEQ ID NO 98
atggggaagaaaggaaaaggatggtttacatctgtgaagagagtgttcaaatcatcatctcctaaggaattaccagtagggaaaaagaaagacaacgcagagaaatggcaacatgaggctccagaagttgtgtcattagagcattttcctactggaagttctcctgatgttacaaatgatgagagcaatgtatcaactccagtaactgaagatagaaatcatgccattgctgtggcagtagcgactgctgccgcagcagaagctgcggttgcagctgctcaagcggcggctaaagttgttcgcttagctggttatggacgacaatcaaaggaagaaagagctgccatcctcatacaatcattctataggggctaccttgctcggcgtgccttacgcgcattgaagggattggtgaggctccaagcattagtgagaggccacaatgtaagaaagcaagcacaaatgacaatgagaagcatgcaagctcttgttcgtgtgcaagcaagagtaagagcaagaagacttgaattagctcacgagaagcttcaaaggaagacagaggaagaagatgaacgaagactaccagtggacgaagactttatgaatccaaagaatccattgaagagttataaatgggataggaggaatcaaagttcagataatttcaaagaaaatgcttcaaagaagcatgatgctgtcatgaaaagagagagagcccttgcttatgcttatgccttccagcagcagcagcagcaacaattactctcacaaaatagtcctaatggtaaagaaacaggacattttgtgaacgaacacgagaagatgcaatggggatggaattggcttgagagatggatgtcagcacaatcatataacgtgcgtcaatcgggtccaaatgaagggtcttacgtgacagtaaacacaactacaaccacgaccaccacagaggacatgtccgagaagacagtagagatggacatggtgaccccaacaggcactagcaatcccaacatgggcatgctagacaccaatccatattcgaatcgaccccaatggcaatcaagttcaagcaatgtacgtagctacatggctccgacccagtccgcaaaggcgaaagtgcgttctcaaagtttgatcaagcaacgtgccccagcgacacctctgtggaatccatccaccaagaaagattcaagcattgttggtccaggttgtgattcttccagttcaggtggtggaacaacaacttatcacgctccaagaagtcctagccccaaacataacgggatgcgcctgcattcgagaagacatgctggtggatatagccctgatttcaatggcggtgatgattggaggttgcctcctcttgatggtcatggatggaggaatgattttggttga

SEQ ID NO: 98 - protein, 309 aa, Populus balsamifera subsp. trichocarpa
  misc_feature: Ceres ANNOT ID no.1520883
  misc_feature: Score of 495.7 for HMM of FIGURE 1.
  misc_feature: Functional Homolog Of Ceres SEEDLINE ID no. ME08768 at SEQ ID NO. 86
MRSMQALVRVQARVRARRLELAHEKLQRKTEEEDERRLPVDEDFMNPKNPLKSYKWDRRNQSSDNFKENASKKHDAVMKRERALAYAYAFQQQQQQQLLSQNSPNGKETGHFVNEHEKMQWGWNWLERWMSAQSYNVRQSGPNEGSYVTVNTTTTTTTTEDMSEKTVEMDMVTPTGTSNPNMGMLDTNPYSNRPQWQSSSSNVRSYMAPTQSAKAKVRSQSLIKQRAPATPLWNPSTKKDSSIVGPGCDSSSSGGGTTTYHAPRSPSPKHNGMRLHSRRHAGGYSPDFNGGDDWRLPPLDGHGWRNDFG

SEQ ID NO: 99 - DNA, 1445 bp, Arabidopsis thaliana
  misc_feature: Ceres CLONE ID no.148018
  misc_feature: Encodes the peptide sequence at SEQ ID NO 100
attgggatttcatttagataatttttttttgggtcttgatctaagttttgttctttctaatttggtaaggcaagaagagcattaagagcattaaaagggttagtgaagctacaagcattggtgaggggacataatgtgagaaagcaagctaaaatgacattaaggtgtatgcaagctctggttcgagtccagtctcgtgtgcttgaccaacgcaaacgcttgtctcatgacggtagtcgcaaatccgcgttcagtgactctcacgctgtttttgaatctcgctatcttcaagatttgtcagatcgacaatccatgtcaagagaaggaagcagcgccgcggaagattgggatgaccgaccacacacgatagacgcagtgaaagtgatgctacaacggagacgggacacagcattgagacatgacaagactaatttgtcacaagctttctctcaaaagatgtggaggacggttggtaaccaatccacggaaggacaccacgaggtagaacttgaagaggaaaggccaaaatggcttgaccggtggatggctactagaccgtgggataaacgagctagtagtagagcttcggttgaccaaagggtttcagttaaaaccgttgaaatcgacacttctcagccttactcaagaacaggagcaggaagcccgagtcgtggccaaagacctagttccccatcaagaactagccaccattaccaatcccgcaataatttctcagccactccatctccggctaagtctagaccaatacttattcggtcagctagtccacggtgccagagagacccgagggaagaccgtgaccgagcagcttatagttatacatcaaacacaccaagcttgagatccaattatagtttcacagctaggagtggatgtacattagtaccacaatggttaataatgcatcattgttgcctaattacatggcgagtacagagtcagctaaagcgaggatccggtctcatagtgcaccgaggcaacggccctcaactcccgagagggaccgtgcggstttrgctacaagaaacgrytctsgtatccggtaccaccgccagcggagtatgaggacaataatagcttaaggagtccaagctttaagagtgtggctggttcacattttggtggaatgttagagcagcaatcgaattactcttcatgttgcactgagtctaacggtgttgagatctctccagcttctactagtgactttaggaattggcttagatgattggtggtgatgccaaatcaactgtcaagatctttcatcatcctccaggaaaagaacgttttaaaattttatattccagaagaaaacaaacacttttatattgtgtcgttgaggttgatttgtgtttggaagataagtttattgacctattgatctgtaacttcataagattttgaaacgttagaagattcaaaag

SEQ ID NO: 100 - protein, 310 aa, Arabidopsis thaliana
  misc_feature: Ceres CLONE ID no.148018
  misc_feature: Score of 458.7 for HMM of FIGURE 1.
  misc_feature: Functional Homolog Of Ceres SEEDLINE ID no. ME08768 at SEQ ID NO. 86
  misc_feature (294)..(294): Xaa is any aa, unknown, or other
  misc_feature (295)..(295): Xaa is any aa, unknown, or other
  misc_feature (300)..(300): Xaa is any aa, unknown, or other
  misc_feature (301)..(301): Xaa is any aa, unknown, or other
MTLRCMQALVRVQSRVLDQRKRLSHDGSRKSAFSDSHAVFESRYLQDLSDRQSMSREGSSAAEDWDDRPHTIDAVKVMLQRRRDTALRHDKTNLSQAFSQKMWRTVGNQSTEGHHEVELEEERPKWLDRWMATRPWDKRASSRASVDQRVSVKTVEIDTSQPYSRTGAGSPSRGQRPSSPSRTSHHYQSRNNFSATPSPAKSRPILIRSASPRCQRDPREDRDRAAYSYTSNTPSLRSNYSFTARSGCTLVPQWLIMHHCCLITWRVQSQLKRGSGLIVHRGNGPQLPRGTVRXXLQETXXVSGTTASGV

SEQ ID NO: 101 - protein, 364 aa, Arabidopsis thaliana
  misc_feature: Public GI ID no.18378797
  misc_feature: Score of 546.8 for HMM of FIGURE 1.
  misc_feature: Functional Homolog Of Ceres SEEDLINE ID no. ME08768 at SEQ ID NO. 86
MTLRCMQALVRVQSRVLDQRKRLSHDGSRKSAFSDSHAVFESRYLQDLSDRQSMSREGSSAAEDWDDRPHTIDAVKVMLQRRRDTALRHDKTNLSQAFSQKMWRTVGNQSTEGHHEVELEEERPKWLDRWMATRPWDKRASSRASVDQRVSVKTVEIDTSQPYSRTGAGSPSRGQRPSSPSRTSHHYQSRNNFSATPSPAKSRPILIRSASPRCQRDPREDRDRAAYSYTSNTPSLRSNYSFTARSGCSISTTMVNNASLLPNYMASTESAKARIRSHSAPRQRPSTPERDRAGLVKKRLSYPVPPPAEYEDNNSLRSPSFKSVAGSHFGGMLEQQSNYSSCCTESNGVEISPASTSDFRNWLR

SEQ ID NO: 102 - protein, 364 aa, Arabidopsis thaliana
  misc_feature: Public GI ID no.21553500
  misc_feature: Score of 524.9 for HMM of FIGURE 1.
  misc_feature: Functional Homolog Of Ceres SEEDLINE ID no. ME08768 at SEQ ID NO. 86
  misc_feature (288)..(288): Xaa is any aa, unknown, or other
  misc_feature (294)..(294): Xaa is any aa, unknown, or other
  misc_feature (296)..(296): Xaa is any aa, unknown, or other
  misc_feature (300)..(300): Xaa is any aa, unknown, or other
  misc_feature (301)..(301): Xaa is any aa, unknown, or other
MTLRCMQALVRVQSRVLDQRKRLSHDGSRKSAFSDSHAVFESRYLQDLSDRQSMSREGSSAAEDWDDRPHTIDAVKVMLQRRRDTALRHDKTNLSQAFSQKMWRTVGNQSTEGHHEVELEEERPKWLDRWMATRPWDKRASSRASVDQRVSVKTVEIDTSQPYSRTGAGSPSRGQRPSSPSRTSHHYQSRNNFSATPSPAKSRPILIRSASPRCQRDPREDRDRAAYSYTSNTPSLRSNYSFTARSGCSISTTMVNNASLLPNYMASTESAKARIRSHSAPRQRPSTXERDRAXLXKKRXXYPVPPPAEYEDNNSLRSPSFKSVAGSHFGGMLEQQSNYSSCCTESNGVEISPASTSDFRNWLR

SEQ ID NO: 103 - DNA, 1713 bp, Populus balsamifera subsp. trichocarpa
  misc_feature: Ceres ANNOT ID no.1444522
  misc_feature: Encodes the peptide sequence at SEQ ID NO 104
atggggaagaagggaggtagctcatggttgactgctgtgaaaagggcgtttagatctccaactaaagaaagtgacaagagggctactggggttggccatgaccaagaagaagatgaagaaaagaagagagggaagagaagatggttatttaggaaacctacaaatcaagaaacggcgacacaacagaacctgtcaaaggcaggaaatgttaaggcatccccaggtggtggtggaggtgctccagcagaccatgtgtcggcagctgcagcagctgagcaaaggcatgcaattgcagtagcagttgctactgcagctgcagctgaagctgctgtagccactgcccaggcggcggcggaggttgctcggctcactaggccttcatatcatcctagagaacattatgctgccattgtcattcaaacagcttttagaggatacttggcaaggcgggctcttcgtgcacttaaagggctagtgaagttgcaagctttagtaaggggacacaatgtgagaaaacaggccaagatgaccctgcgatgcatgcaagctctggctcgagtgcaggctcgagtgcttgatcaacgcgtgagactttcacatgaaggcagcaggaaatctgcatttagtgacaccaatagcgtgcttgaatcgcgatatcttcaagacatttcagatagaaaatccatgtcaagagaaagcagtagcattgcagatgattgggatgatcggccacactccattgaggaagtcaaggccatgttgcaacgcaggaaagaagctgcgttcaagcgtgaaaagaccttatctcaagctttctctcagcagctcatggctaattggttcaattttttcaaacccatgtccaagatatggagaaatggcagaagcccatcaaatggcaatgaagatgagctccaagaaagaccacaatggcttgatcaatggatgcctgcaaagccatgggacaatagcagcagagcaagagcttcaactgatcaaagagaccccatcaaaactgtagaaattgacacctcccaaccttattcatatttagttcctaattttagaagaacaaaccaaaaccaacatcaccaacaccagagatccaattcatcaaacaatggtgtggcacactctgctccttctccactccatagagctcatcaaactgctccactccaccactctcctatcacaccctccccatcaaaaactaggcctcttcaggttcgttcagctagtccacgatgtgcaagagaagatagaagttgtaattcctctcaaacaccaagtttaaggtccaattatttttacaatggaagtttgaatcaacatggaatcaggggtggtgctagtgttagtagtaatggtaatgctacattgccaaattacatggctgcaaccgagtctgccaaggctagattgagatcacagagtgcaccaaggcaaagaccatcaacaccagaacgagaccggattgggtctgcaagaaaacggctttcgtatccagcccccgacccttgtgatgtcggtatagtttatggcggtgctggttacggccatggtttaaggagtccaagctttaagagcgtgagcggttcacgtttgggtggactagaacaacagtctaactattcttcttgctgtacggatagctttggtggtgagctttccccttcttcaactaacgatcttaggaggtggttgagatga

SEQ ID NO: 104 - protein, 395 aa, Populus balsamifera subsp. trichocarpa
  misc_feature: Ceres ANNOT ID no.1444522
  misc_feature: Score of 439.2 for HMM of FIGURE 1.
  misc_feature: Functional Homolog Of Ceres SEEDLINE ID no. ME08768 at SEQ ID NO. 86
MTLRCMQALARVQARVLDQRVRLSHEGSRKSAFSDTNSVLESRYLQDISDRKSMSRESSSIADDWDDRPHSIEEVKAMLQRRKEAAFKREKTLSQAFSQQLMANWFNFFKPMSKIWRNGRSPSNGNEDELQERPQWLDQWMPAKPWDNSSRARASTDQRDPIKTVEIDTSQPYSYLVPNFRRTNQNQHHQHQRSNSSNNGVAHSAPSPLHRAHQTAPLHHSPITPSPSKTRPLQVRSASPRCAREDRSCNSSQTPSLRSNYFYNGSLNQHGIRGGASVSSNGNATLPNYMAATESAKARLRSQSAPRQRPSTPERDRIGSARKRLSYPAPDPCDVGIVYGGAGYGHGLRSPSFKSVSGSRLGGLEQQSNYSSCCTDSFGGELSPSSTNDLRRWLR

SEQ ID NO: 105 - DNA, 1443 bp, Populus balsamifera subsp. trichocarpa
  misc_feature: Ceres ANNOT ID no.1467519
  misc_feature: Encodes the peptide sequence at SEQ ID NO 106
atggggaagaaaggaaaaggatggtttacatctgtgaagagagtgttcaaatcatcatctcctaaggaattaccagtagggaaaaagaaagacaacgcagagaaatggcaacatgaggctccagaagttgtgtcattagagcattttcctactggaagttctcctgatgttacaaatgatgagagcaatgtatcaactccagtaactgaagatagaaatcatgccattgctgtggcagtagcgactgctgccgcagcagaagctgcggttgcagctgctcaagcggcggctaaagttgttcgcttagctggttatggacgacaatcaaaggaagaaagagctgccatcctcatacaatcattctataggggctaccttgtaatccctttcttcatttcactttattttgatcaatataatctggctcggcgtgccttacgcgcattgaagggattggtgaggctccaagcattagtgagaggccacaatgtaagaaagcaagcacaaatgacaatgagaagcatgcaagctcttgttcgtgtgcaagcaagagtaagagcaagaagacttgaattagctcacgagaagcttcaaaggaagacagaggaagaagatgaacgaagactaccagtggacgaagactttatgaatccaaagaatccattgaagagttataaatgggataggaggaatcaaagttcagataatttcaaagaaaatgcttcaaagaagcatgatgctgtcatgaaaagagagagagcccttgcttatgcttatgccttccagcagcagcagcagcaacaattactctcacaaaatagtcctaatggtaaagaaacaggacattttgtgaacgaacacgagaagatgcaatggggatggaattggcttgagagatggatgtcagcacaatcatataacgtgcgtcaatcgggtccaaatgaagggtcttacgtgacagtaaacacaactacaaccacgaccaccacagaggacatgtccgagaagacagtagagatggacatggtgaccccaacaggcactagcaatcccaacatgggcatgctagacaccaatccatattcgaatcgaccccaatggcaatcaagttcaagcaatgtacgtagctacatggctccgacccagtccgcaaaggcgaaagtgcgttctcaaagtttgatcaagcaacgtgccccagcgacacctctgtggaatccatccaccaagaaagattcaagcattgttggtccaggttgtgattcttccagttcaggtggtggaacaacaacttatcacgctccaagaagtcctagccccaaacataacgggatgcgcctgcattcgagaagacatgctggtggatatagccctgatttcaatggcggtgatgattggaggttgcctcctcttgatggtcatggatggaggaatgattttggttga

SEQ ID NO: 106 - protein, 309 aa, Populus balsamifera subsp. trichocarpa; identical to SEQ ID NO: 98
  misc_feature: Ceres ANNOT ID no.1467519
  misc_feature: Score of 495.7 for HMM of FIGURE 1.
  misc_feature: Functional Homolog Of Ceres SEEDLINE ID no. ME08768 at SEQ ID NO. 86

SEQ ID NO: 107 - protein, 291 aa, Oryza sativa subsp. indica
  misc_feature: Public GI ID no.125559938
  misc_feature: Score of 403.9 for HMM of FIGURE 1.
  misc_feature: Functional Homolog Of Ceres SEEDLINE ID no. ME08768 at SEQ ID NO. 86
MQRLQERSRDGSSFAAGDDWDDRPRTIEEIQAMLQTRKDAALKRERALSYAFSHQIWRNPAPSVEEMDVDGQPRWAERWMASRASFDTSRSTVRASAAAAPGRASTDHRDQVKTLEIDTARPFSYSTPRRHGNASYHASSSPMHRAHHHSPVTPSPSKARPPIQVRSASPRVERGGGGGGSYTPSLHSHRHHASSGGAAAVPNYMAATESAKARDVIRGAARRGAKKRLSFPVPIDPYGAYAQSLRSPSFKSAAGRFSSEQRSNVSSSCAESLGGDVVSPSSTTDLRRWLR

SEQ ID NO: 108 - DNA, 1509 bp, Arabidopsis thaliana
  misc_feature: Ceres SEEDLINE ID no.ME19173
  misc_feature: Encodes the peptide sequence at SEQ ID NO. 109
acattctccgatattctctctctctctatcaatctctcactctcaaactttctacatacctgaagaaaaaaataatctacgaattcgagccaaaaagatcgaaactttttaatctatgggtgcttcagggaaatgggtcaagtccattatcggtctcaagaagctagagaaggatgaaatcgaaaagggtaatgggaaaaacaagaaatggaagctatggaggactacttcagtagattcatggaagggttttcgaggaaaacatcggtctgattcagacggtgttgattcttctactgtttactctgctgctgttgctactgttcttagagctcctcctaaagatttcaaagctgttagagaagaatgggctgctattagaatccaaaccgcttttcgtggattcttggcgagaagagcgttgagggcattgaaagggatagtgaggttacaagctttagtgagaggaagacaagttaggaaacaagcagctgttacattgagatgcatgcaagctttggtgagagtacaagctcgtgttagagctcgtcgtgtgaggatgactgttgaaggacaagctgttcaaaagcttttagatgaacatagaaccaaatctgatctcttgaaagaagtcgaggaagggtggtgtgataggaaaggtactgtggatgatattaagtcaaagttgcagcagagacaagaaggtgcttttaagagggaacgtgctttggcttatgctcttgctcaaaagcaatggaggtcaactactagctcaaaccttaagacgaatagttcgatttcgtatcttaaaagtcaagagtttgataagaatagttggggatggagttggttggagcgttggatggctgctaggccatgggagactagacttatggacactgttgataccgctgccacgcctcctcctctgcctcataaacatttgaaatcaccggaaactgcggatgttgttcaagttagaagaaacaatgtgaccactagagtatctgcaaaacctcctcctcatatgctgtcttcaagtcctggttatgagtttaacgagagctcaggttcatcctcgatttgtacttcaactacgcctgtttctggaaaaactggacttgtttcagataactctagcagtcaagcaaaaaagcacaagccaagttacatgagcttgactgaatcgacaaaggctaagcgaagaactaaccgcggtctcaggcaatctatggatgagtttcagtttatgaagaactctggaatgtttacaggggaattgaagactagtccttcctcagatccttttgttagtttctccaaaccactcggtgttcctactcgattcgagaagccgagaggttaaatgtgaccttgttagattggagtttcaacagcttgttgttgtcttgtgtgttgtgagatatctgtgtatgttgttaattgttctttttcctttggaactacattggagttttgaatttaaatataaatttcagtcttgctttt

SEQ ID NO: 109 - protein, 416 aa, Arabidopsis thaliana
  misc_feature: Ceres SEEDLINE ID no.ME19173
  misc_feature: Score of 954.4 for HMM of FIGURE 3.
  misc_feature (84)..(104): Pfam Name: IQ Pfam Description: IQ calmodulin-binding motif
MGASGKWVKSIIGLKKLEKDEIEKGNGKNKKWKLWRTTSVDSWKGFRGKHRSDSDGVDSSTVYSAAVATVLRAPPKDFKAVREEWAAIRIQTAFRGFLARRALRALKGIVRLQALVRGRQVRKQAAVTLRCMQALVRVQARVRARRVRMTVEGQAVQKLLDEHRTKSDLLKEVEEGWCDRKGTVDDIKSKLQQRQEGAFKRERALAYALAQKQWRSTTSSNLKTNSSISYLKSQEFDKNSWGWSWLERWMAARPWETRLMDTVDTAATPPPLPHKHLKSPETADVVQVRRNNVTTRVSAKPPPHMLSSSPGYEFNESSGSSSICTSTTPVSGKTGLVSDNSSSQAKKHKPSYMSLTESTKAKRRTNRGLRQSMDEFQFMKNSGMFTGELKTSPSSDPFVSFSKPLGVPTRFEKPRG

SEQ ID NO: 110 - protein, 442 aa, Oryza sativa subsp. japonica
  misc_feature: Public GI ID no.115435054
  misc_feature: Score of 949.2 for HMM of FIGURE 3.
  misc_feature: Functional Homolog Of Ceres SEEDLINE ID no. ME19173 at SEQ ID NO. 109
  misc_feature (109)..(129): Pfam Name: IQ Pfam Description: IQ calmodulin-binding motif
MGGSGKWVKSLIGLKKPDREDCKEKLQVPSVNGRGGGKGRKWKLWRSSSGDHGSLWRGSRGGGGGGGHHRSASSDASDDASSAAADPFTAAVATVARAPAKDFMAVRQEWAAIRVQTAFRGFLARRALRALKGLVRLQAIVRGRQVRKQAAVTLRCMQALVRVQARIRARRVRMSTEGQAVQKLLEARRTKLDILREAEEGWCDSQGTLEDVRVKLQKRQEGAIKRERAIAYAYSQQIEGATKCNQQPKPTSYGRLNQSGMLLKHQHFDKSNGNWSWLERWMAARPWENRLMEEHNQTNSSSPDLLSSKNCEDSFGILGDFSEPNSVKVRKNNVSKRVCAKPPVVSHHQRIKAQSISSLSTELHNDESSASSSSCFASTPISFSTFVTTEKTEDSIRARPNYMNMTESIKAKRKACNAQRTTAGKLMEDRKASGVELKVAQV

SEQ ID NO: 111 - DNA, 1661 bp, Gossypium hirsutum
  misc_feature: Ceres CLONE ID no.1847857
  misc_feature: Encodes the peptide sequence at SEQ ID NO 112
attttttttctctttgagtcttgttgaagacttgaggttctctcccccccccccacctttttttggtgcaaaaagatttcctttttgtcactcatactctgttatcaattgtttccatcgtagcccatttcctttttcttttcttaaataacagttgtttgtatctctgagaaaaatatatactttgaaactaccatgggtgcttcagcgaaatgggtgaaatctcttattggtctcaagaaaactgtaaaagatgaccaagaaaagatgggtggcaagagcaagaaatggaagctatggaggagttcttcaggggatggaataggttcctcatggaagggttttaaaggaaagtttaaagcagattacgaaggatctgattcttcaccaaggtctgaagctttctctgctgccatggctgctgtggttcgagctcctcctaaagatttcagggttgtaaggcaagaatgggctgctatccgcattcaaactgctttccgaggcttcttggcaagaagggctttaagggctttaaagggagtcgttaggatccaagcctttgttcgcggtcgacaggtgaggaaacaggctgctgtgacactccggtgcatgcaagctctcgttcgtgtccaagctcgtgttagagctcgtcgtgtccgaatgtccatcgagggccaggcagttcaaaagatactcgatgaacaccgcagcaaggccgaactcttgaaacaagccgaggagggctggtgtgatagtaaaggaacattggatgatgttacaataaagctacaactgagacaagaaggtgctttcaagagagaacgagcacttgcttattctcttgcacaaaagcaatggagattgaacatggattcaaatactcgaacaaatagttcggtttcagttccatatctcaaaaaccaagtgtttgataagaatagttggggatggagttggcttgaacgttggatggcagcccggccgtgggaaactcgattgatggagcaatcacaggcagacccttccgaaccaactccaccatcgaaaacttgttcagagtctagaaagattactagaccgaccgaaccatgttcagtgaaggtacgaaagaacaatgtcacaactaggatttcagcaaagcctccccatattggtcaaggtactagatcatcatcgagtccaagttccgaattccggttcgaagagagctccgcatcatcatcgatatgcacatctacaacacgggtctcgtggaatacaatgccgacttcagagagaacggagaagacggggaatagtaggccaaactatatgaacttgacagagtctaccaaggccaaacaaagagctgcaaatcatgccttacgaagaatccaaatgcagtccatggatgagttccagttaaagaaaacagctggtttgtatgatggggattcaaagagtagtgtggggtcggatcctacggtccatatgtctcggccactgtatccaccaacaagattaggttaaaagtggttgtgtctgtgattaagtagatcgtcagttttattatgttttccaacatcttgtttagttttagtgtgatgtagcaaacaagttgttgagtgtttttgtatctaattcgacggcaattcattctgcaaaaaaaaaaaaaaaaaaaa

SEQ ID NO: 112 - protein, 437 aa, Gossypium hirsutum
  misc_feature: Ceres CLONE ID no.1847857
  misc_feature: Score of 1019.5 for HMM of FIGURE 3.
  misc_feature: Functional Homolog Of Ceres SEEDLINE ID no. ME19173 at SEQ ID NO. 109
  misc_feature (91)..(111): Pfam Name: IQ Pfam Description: IQ calmodulin-binding motif
MGASAKWVKSLIGLKKTVKDDQEKMGGKSKKWKLWRSSSGDGIGSSWKGFKGKFKADYEGSDSSPRSEAFSAAMAAVVRAPPKDFRVVRQEWAAIRIQTAFRGFLARRALRALKGVVRIQAFVRGRQVRKQAAVTLRCMQALVRVQARVRARRVRMSIEGQAVQKILDEHRSKAELLKQAEEGWCDSKGTLDDVTIKLQLRQEGAFKRERALAYSLAQKQWRLNMDSNTRTNSSVSVPYLKNQVFDKNSWGWSWLERWMAARPWETRLMEQSQADPSEPTPPSKTCSESRKITRPTEPCSVKVRKNNVTTRISAKPPHIGQGTRSSSSPSSEFRFEESSASSSICTSTTRVSWNTMPTSERTEKTGNSRPNYMNLTESTKAKQRAANHALRRIQMQSMDEFQLKKTAGLYDGDSKSSVGSDPTVHMSRPLYPPTRLG

SEQ ID NO: 113 - DNA, 1353 bp, Populus balsamifera subsp. trichocarpa
  misc_feature: Ceres ANNOT ID no.1455219
  misc_feature: Encodes the peptide sequence at SEQ ID NO 114
atgggtgcatcaggaaaatgggtgaaatccattataggtctaaaaaagtctgataaagatcaagaccaatatgagaaggtgagtggaaagagcaagaaatggaagctatggaggagttcatcaggagatttggggtcttcatggaagggtttcaaagggaaccacagagcagcatcagaggcatcgggttcttcaccactggctgatccatttactgctgcaatggctactgtggttagagctcctcctaaggatttcagggttgtcaggcaagaatgggctgctatcaggattcaaactgcttttcgtggattcttggcaagaagggctctgagggccttgaaaggagtggtgagactccaagctctagttcgaggtcgacaagtgaggaagcaggctgcagtgacacttaagtgcatgcaagctcttgttcgtgttcaagctcatgttagggctcgtcgtgtgcgaatgtccttagaagggcaggcagtgcagaatatgctgaatgagcgacgtagcaaggctgacctcttgaaacatgctgaggaagggtggtgtgatagaaaggggacattagaagacgtgaagtcaaaactgcaaatgaggcaagaaggagccttcaagagagaaagagctattgcttactcccttgctcaaaaacaatggagatcaaaccccagctcaaacactcgacccaataactcggtatattctttcaagaatgaggagtttgataagaatagctggggatggagttggcttgaacgttggatggcagccaagccatgggagactagattgatggaacaaacccatactgatccctcagtgactccaccacccaagtcctgtgtagatgcaagcacacattcgaaatcctttgaacaaagttcagtgaaagtgagaaagaacaatgtaaccactagaatttcagcgagacctccaatcgggcatgttactcgctcatcttcaagtccaagttctgaagtccgctttgatgagagctcagcttcttcatcaatttgtacttctacaacaccaatatcaggaaacactggcttggcctcagataaaacagaggagagtggtaacagcaggccaaactacatgaacctgaccgagtcaaccaaggcaaagcaaaacacatccagtcatttatttcataggattcaaaggcagtccatggatgagtttcagtttttcaaaaagtcagcggcgttctcaaatggagattcaaaaagcagtgctggttctgatccttcagttaatttatccaagccactttgcttgccgacaagatttgataagaactcgatgaaacaaataagaggaacggatcatttgtatgcctag

SEQ ID NO: 114 - protein, 450 aa, Populus balsamifera subsp. trichocarpa
  misc_feature: Ceres ANNOT ID no.1455219
  misc_feature: Score of 1091.4 for HMM of FIGURE 3.
  misc_feature: Functional Homolog Of Ceres SEEDLINE ID no. ME19173 at SEQ ID NO. 109
  misc_feature (92)..(112): Pfam Name: IQ Pfam Description: IQ calmodulin-binding motif
MGASGKWVKSIIGLKKSDKDQDQYEKVSGKSKKWKLWRSSSGDLGSSWKGFKGNHRAASEASGSSPLADPFTAAMATVVRAPPKDFRVVRQEWAAIRIQTAFRGFLARRALRALKGVVRLQALVRGRQVRKQAAVTLKCMQALVRVQAHVRARRVRMSLEGQAVQNMLNERRSKADLLKHAEEGWCDRKGTLEDVKSKLQMRQEGAFKRERAIAYSLAQKQWRSNPSSNTRPNNSVYSFKNEEFDKNSWGWSWLERWMAAKPWETRLMEQTHTDPSVTPPPKSCVDASTHSKSFEQSSVKVRKNNVTTRISARPPIGHVTRSSSSPSSEVRFDESSASSSICTSTTPISGNTGLASDKTEESGNSRPNYMNLTESTKAKQNTSSHLFHRIQRQSMDEFQFFKKSAAFSNGDSKSSAGSDPSVNLSKPLCLPTRFDKNSMKQIRGTDHLYA

SEQ ID NO: 115 - DNA, 1433 bp, Zea mays
  misc_feature: Ceres CLONE ID no.352452
  misc_feature: Encodes the peptide sequence at SEQ ID NO 116
cccacacggcagcaggcagggcgccatctcctagcagctcctcccatggcgtcctctgcccttcttctcctccatggccgccgaagcccctcccatggccgacgctctctgctccagcccctccagcagctatggcgtcccccctcctccccttcttcttcctcaagccagcaggcacctccctctactccctgcgcgcagcagcagccatggcgctgcctctcttctccatggcgagtagcagctcattcacctctctctcccatggcgtgctgctccagtcggcctcccttctccccctcggctccttcctccaggccgggccgtgcagaagctgctcgaggcgcgccgcacccagatggatatcctcagggaagccgaggaaggatggtgtgacagccagggaacacttgaacaagtgagggtcaagctgcagaagcggcaggagggcgcaatcaagcgtgagcgggctatcgcctatgcatattcgcagcaggccgacggtgctgccaaatgcaatccaccgaagcttacttccaatggactggtgaaccactccggcatgctgctcaagcaccagaacttagacaagggcaacggcaactggagctggctggagaggtggatggcagcgcggccatgggagaacaggctgatggaggagcacaactccagctccccggacttccggtcctccaagaactgcgaggactcctttggtgtgctcggcgacttctctgaaccgaactcagtgaaggtgcgcaagaacaatgtcagcaagcgggtctgcgcaaaacctccagggccaacacacgcccacggacatcatcagcgcctcaaggcccagtcgatctcgtctctgagcactgagctgcacaacgacgagagctccgcgtcctcctcgtcttgctttgcgtctacccctatatcattcacacttgtggcttcggagaagaccgaggacagcgtcaggacgagacccaactacatgagcatgacggagtcgatcaaggctaagcagaaggcatgcagcgcccagaggacggtggcgctgaagcaatgtgatgataggaaagccatgagcgccgagttgaaggtcgctcaggtgtgactgtttcgtggaactccatgcagagatggagccgacttcgacatcctctctatgccctaggatgtgttgcttggtgtcttgccacattcttgagtggctcggtgctgcattcctgagttgtcctcctgttgctgggtgtctgattattcaacttcttgttgtcagattgcatctttgttcagtcattgtggctgcatctttgttcagccgttgtggctttgtcagtggtagagtctctgtaagatagttctttgagtagacagcattgtggatttctttcctgggtgttgatttcaggtcaaaaaagacaggataatttact

SEQ ID NO: 116 - protein, 250 aa, Zea mays
  misc_feature: Ceres CLONE ID no.352452
  misc_feature: Score of 121.9 for HMM of FIGURE 3.
  misc_feature: Functional Homolog Of Ceres SEEDLINE ID no. ME19173 at SEQ ID NO. 109
MDILREAEEGWCDSQGTLEQVRVKLQKRQEGAIKRERAIAYAYSQQADGAAKCNPPKLTSNGLVNHSGMLLKHQNLDKGNGNWSWLERWMAARPWENRLMEEHNSSSPDFRSSKNCEDSFGVLGDFSEPNSVKVRKNNVSKRVCAKPPGPTHAHGHHQRLKAQSISSLSTELHNDESSASSSSCFASTPISFTLVASEKTEDSVRTRPNYMSMTESIKAKQKACSAQRTVALKQCDDRKAMSAELKVAQV

SEQ ID NO: 117 - DNA, 1949 bp, Triticum aestivum
  misc_feature: Ceres CLONE ID no.787908
  misc_feature: Encodes the peptide sequence at SEQ ID NO 118
acacaggcaggcagccgagccgagcgagcaataattcgcaccggcacacaggagcggcagtaatggccgcgtggtgccggtgccagtagcaggcaggcaggcaggggagtagcgccactgcactgggcactgctgacgcttcgagcccacgctcttccctccacccttgcccctccctcccgaaactccctccctcccttggcctcctcaggcctcccaatctcgcagagcggcggccgtcattggccggcggcggtgcgcggccccggttgtttcctccggcgtcaggtgcccgtgatctggttgttgcagaggcggcgaggtgaggtgacgcggcggcgcgatgaggtggctcaagtcgttggttgggctgaggaaggtggagaggcagcagcagcgccgcaaggaggatggcgacgccggcccaacaaaaacagatgccgtcgatcagttccacttccaggatcagcactcccaggatcacgctagccttgtcggaccagaagagttccctgatgaaaatggtccgtcagaagatgagtgcgatacaccttcatgctcaggacctggtttcagtatgcttagtgtgccactgcctcaaacagaagaggagctcaaagagatctgggctgccacaattattcagactgcatatagagccctactggctaggagagcccgccgagctttaaaaggactggttaggcttcaagcccttgtaaggggtcatatagtgagaaagcaagctgctataacacttcggtgtatgcaagctttggtcagggtacaagcccgtgttagagcaaggcgggttcgtgtggccttggaaaatcagatggatgagcaacaaaataatgtagaagagcaaacggacgaggcacatgttcgagaagttgaggatgggtggtgcgatagtatagggtctgtggaagacatccaagcaaaattgttgaagaggcaggaagcagcagccaagcgtgagagagccatggcctatgccctttctcaccagtggcaagcaggttcaaggcaacaggcagccattacagcttctgaactagacaggaacagctggagctggaattggctggagagatggatggccgtccgcccgtgggagagtcggttccttggcatgtacgcagcagatggaattgccattgataccggagcgcacaatgctgagggaaatgcaaccaaggctccatacaggaaacctgtgaaaaagcaggtttcagctcttcattcaagtgtgttgatccagaaggcccgcccctcgaactcggagggtggtggctccttgtcgaacccgtctgccggttcggcgtcagctaaaccgaaacggaagctgccaccaaaggaaggttctgatgaagtctcgtctcgtctttcgggacttggtgcccggagcagtagtaatcctaaggagaggcctgggcagttacaacctcgggccaacaagaggttctccttgcctggcactggcacagaagttggcaaacggcaagtgaataaacctgcggtgaaccgatcccccaaggctaccgaagactccccagcgctggaagggaagcatcgccgtgccggttccgttggtctgctgctcaagagagttgagctgcaggcttgacaagccatctgaagccccatctaccgtcgtcaaggttcgaagtcagcatgctgcgctctgatacatgggcggccttagattctggaaggtccattggagcaatgtgcatttatttcttagccatattataggtatgcagtcaaaatgctcatctcaggagatgagatctagctagtgcttggatatgtatgtgctggtcagctggtgcctctagtcctggaggttaccatagcttgtactgttgtatttgtagctaagagcaagtatgggctcacattttctggaactattttttgtacaatgaaaaaaaaaaaaaaaa

SEQ ID NO: 118 - protein, 428 aa, Triticum aestivum
  misc_feature: Ceres CLONE ID no.787908
  misc_feature: Score of 891.9 for HMM of FIGURE 3.
  misc_feature: Functional Homolog Of Ceres SEEDLINE ID no. ME19173 at SEQ ID NO. 109
  misc_feature (94)..(112): Pfam Name: IQ Pfam Description: IQ calmodulin-binding motif
MRWLKSLVGLRKVERQQQRRKEDGDAGPTKTDAVDQFHFQDQHSQDHASLVGPEEFPDENGPSEDECDTPSCSGPGFSMLSVPLPQTEEELKEIWAATIIQTAYRALLARRARRALKGLVRLQALVRGHIVRKQAAITLRCMQALVRVQARVRARRVRVALENQMDEQQNNVEEQTDEAHVREVEDGWCDSIGSVEDIQAKLLKRQEAAAKRERAMAYALSHQWQAGSRQQAAITASELDRNSWSWNWLERWMAVRPWESRFLGMYAADGIAIDTGAHNAEGNATKAPYRKPVKKQVSALHSSVLIQKARPSNSEGGGSLSNPSAGSASAKPKRKLPPKEGSDEVSSRLSGLGARSSSNPKERPGQLQPRANKRFSLPGTGTEVGKRQVNKPAVNRSPKATEDSPALEGKHRRAGSVGLLLKRVELQA

SEQ ID NO: 119 - protein, 442 aa, Unknown; identical to SEQ ID NO: 110
  Plant derived amino acid sequence
  misc_feature: Ceres LOCUS ID no. Os01m00929_AP002743
  misc_feature: Score of 949.2 for HMM of FIGURE 3.
  misc_feature: Functional Homolog Of Ceres SEEDLINE ID no. ME19173 at SEQ ID NO. 109
  misc_feature (109)..(129): Pfam Name: IQ Pfam Description: IQ calmodulin-binding motif

SEQ ID NO: 120 - DNA, 1801 bp, Zea mays
  misc_feature: Ceres CLONE ID no.246398
  misc_feature: Encodes the peptide sequence at SEQ ID NO 121
gtctcgtctctacgcccgctctccactcttcctcccaaagcctgccgccgcgtggggggttgcttgctggctgcccgctcctctccctgctcctcctgtgtctgccgcccaccgcttccgggaacaagtccggttgccgccgccgccgtcgctgctctgtccgagaggagggaggaacagagcgggatgggagggtccgggaagtgggtcaagtcgctgatagggctcaagaagcagcccgagaaggaagactgcaaggacaagctgcagctcccatcagtccacggcggaggattgcgaggcaagggccgcaggtggaagctgtggcggacctcctccggcgaccagggctccatgtggcgcggctccagaggcggcagccagcgctcggcggcgtcggaggcctcggacgacgcgtcctcggtggccgccgtccccgccgacccgttcacggccgccgtcgccaccgtcgcccgcgccccggccagggacttcatggccgtccgccaggagtgggccgccatccgcgtccagaccgcgttccgcgggttcttggctcggcgggcgctccgggcgctcaaggggctggtgcggctccaggcgatcgtgcgcgggcggcaggtgcggaagcaggcggccgtgacgctgcggtgcatgcaggcgctggtgcgggtgcaggcgcgcatccgggcgcgccgcgtgcgcatgtccaccgagggccaggccgtgcagaagctgctcgaggcgcgccgcacccagatggatatcctcagggaagccgaggaaggatggtgtgacagccagggaacacttgaacaagtgagggtcaagctgcagaagcggcaggagggcgcaatcaagcgtgagcggggctatcgcctatgcatattcgcagcaggccgacggtgctgccaaatgcaatccaccgaagcttacttccaatggactggtgaaccactccggcatgctgctcaagcaccagaacttagacaagggcaacggcaactggagctggctggagaggtggatggcagcgcggccatgggagaacaggctgatggaggagcacaactccagctccccggacttccggtcctccaagaactgcgaggactcctttggtgtgctcggcgacttctctgaaccgaactcagtgaagatgcgcaagaacaatgtcagcaagcgggtctgcgcaaaacctccagggccaacacacgcccacggacatcatcagcgcctcaaggcccagtcgatctcgtctctgagcactgagctgcacaacgacgagagctccgcgtcctcctcgtcttgctttgcgtctacccctatatcattcacacttgtggcttcggagaagaccgaggacagcgtcaggacgagacccaactacatgagcatgacggagtcgatcaaggctaagcagaaggcatgcagcgcccagaggacggtggcgctgargcaatgtgatgataggaaagccatgagcgccgagttgaaggtcgctcaggtgtgactgtttcgtggaactccatgcagagatggagccgacttcgacatcctctctatgccctaggatgtgttgcttggtgtcttgccacattcttgagtggctcggtgctgcattcctgagttgtcctcctgttgctgggtgtctgattattcaacttcttgttgtcagattgcatctttgttcagtcattgtggctgcatctttgttcagccgttgtggctttgtcagtggtagagtctctgtaagatagttctttgagtakryagtwttgkggatktctktcctrkgtkt

SEQ ID NO: 121 - protein, 318 aa, Zea mays
  misc_feature: Ceres CLONE ID no.246398
  misc_feature: Score of 291.2 for HMM of FIGURE 3.
  misc_feature: Functional Homolog Of Ceres SEEDLINE ID no. ME19173 at SEQ ID NO. 109
  misc_feature (109)..(129): Pfam Name: IQ Pfam Description: IQ calmodulin-binding motif
MGGSGKWVKSLIGLKKQPEKEDCKDKLQLPSVHGGGLRGKGRRWKLWRTSSGDQGSMWRGSRGGSQRSAASEASDDASSVAAVPADPFTAAVATVARAPARDFMAVRQEWAAIRVQTAFRGFLARRALRALKGLVRLQAIVRGRQVRKQAAVTLRCMQALVRVQARIRARRVRMSTEGQAVQKLLEARRTQMDILREAEEGWCDSQGTLEQVRVKLQKRQEGAIKRERGYRLCIFAAGRRCCQMQSTEAYFQWTGEPLRHAAQAPELRQGQRQLELAGEVDGSAAMGEQADGGAQLQLPGLPVLQELRGLLWCARRLL

SEQ ID NO: 122 - protein, 440 aa, Oryza sativa subsp. indica
  misc_feature: Public GI ID no.125527441
  misc_feature: Score of 619.5 for HMM of FIGURE 3.
  misc_feature: Functional Homolog Of Ceres SEEDLINE ID no. ME19173 at SEQ ID NO. 109
  misc_feature (87)..(107): Pfam Name: IQ Pfam Description: IQ calmodulin-binding motif
MGASGKWIRTLVGLRPAAEREKERGGGGGKGRKWSRLWRSSSSQRGGGNASASEVYSETSSSADALSSVVAAVVRAPPRDFRLIRQEWAAVRIQTAFRAFLARRALRALRGIVRLQALVRGRRVRKQLAVTLKCMQALVRVQARARDRRARISADGLDSQDMLDERGGRVDPVKEAEAGWCDSQGTADDVRSKIHMRHEGAIKRERALTYAQSHQRCSNHGGRPSSPAVSLKHHGNGATRSNHSWSYLEGWMATKPWESRLMEQTHTENSTNSRCSESVEEVSVGGPKLSDASSVKIRRNNVTKRVAAKPPSMISATSSDFVCDESSPSTSSVTPLSANNSLATERRSDCGQVGGPSYMSLTKSAKARLSGYGSHKPPLQRQRSGDLLHHNRMAFSSIDVQSTAGSEVSVTSKRLNSLALKGRATRSLDKENERRPSSLL

SEQ ID NO: 123 - protein, 420 aa, Oryza sativa subsp. japonica
  misc_feature: Public GI ID no.125595056
  misc_feature: Score of 536.3 for HMM of FIGURE 3.
  misc_feature: Functional Homolog Of Ceres SEEDLINE ID no. ME19173 at SEQ ID NO. 109
  misc_feature (79)..(99): Pfam Name: IQ Pfam Description: IQ calmodulin-binding motif
MGASGKWIKSLVSLKAAPEGTTKGRRWTRLWRSSSSASASASTAGDASESASSEADAFSSVVAAVVRAPPRDFRVIRQEWAAVRVQAAFRAFLARRALKALRGIVRLQALVRGRLVRRQLAVTLKCMNALLRVQERARERRARCSADGRDSQDAVGERDGRADPIKQAEALILQLLPPFHNEQWCDSQGSVSEVRSKIHMRHDAVAKRERAIAYALSHQPRSSKQSARPSSPARSLRNHESNRCNHDWSYIEGWMATKPWESRLMEQSHAELKCSKNSGELNLAGAQLSNASSVKMRGNRVAAKPPSVLSASSSDFPCDVSSASTSSATPARSDGGHGEGPSYMSLTKSAKARQSCNSPFQIQRQRSGGMSSYKRVALSPLDVQSNACSEFSVTSRKLNSLSLKGRSMTRSLDKENDNLF

SEQ ID NO: 124 - DNA, 1682 bp, Zea mays
  misc_feature: Ceres CLONE ID no.236071
  misc_feature: Encodes the peptide sequence at SEQ ID NO 125
acatcccagtgccgagtgtccccacacaaccaagcggaagcttcggtcgaacagagggagtaagcagttgcgtttcgcattgcgcggcgccgatgggggcgtcggggaagtggatcaagtcgctggtggccctgaaggcgcccgagaaggcggcggggcacaagggcggtcgcaaatggcgtctctggcggagctcgtcggccacgtccagggccagcgccggcgagggcagtgcgctggcgtccgagtcttcttcggcgtcggccgactcgttcaactcggtcctcgccgccgtggtccgcgcgccgcccagggatttcctgctcatcaggcaggaatgggccgccgtccgcatccataccgccttccgcggattcttggcgagacgggcgttgaaggcgctgaggggcatcgtccggctgcaggcgctggtgcgcggccggcgcgtgcgcaagcaactggccgtcacgctcaagtgcatgcacgcactgctgcgggtgcaggaacgcgcccgggagcgccgggcgcgctcctccgctgatggccacggctcacagggccaggacgcgctcaacggctgtgccagttctaccaaagacgctatggaacaatggtgtgaccgccacggatctgttgctgaagtaagatcaaatttacacatgaagcatgaaggtgcagcaaagagagaaagggcaattgcctatgctgtgtctcaccagcctcggggttcaagacagaaggggagaccaagctctcctgctaactgcgttagaagccatgatcctaatgggtgcgatcaggacttcagttacttagacggatggatggcaacgaagccatgggagaccagatctacggagcgaaaccatagcgactcgcagctcgcgaagcacgaggagctgaacttgcccgcctccaagctttccgatgccagctcagttaagatcagaagaaacaatgtcacaactagggtatctgcagcaaagcgtcctcctccatcttcagtgctgtcagctgcttcttccgactccgcgtgcggcggcgagagctctcggtcgagaccatcggtgaccctgacgtctgctaccaccaacactgtcttagcgtcagaagcaagatcagacagtggcgacaccggaggcccgaactacatgagcttgaccaagtctgccaaggcgaggctgagtggatgcagcggcagcagccatcacaggtcgttccagcgaccacggtccggggacatgtcgagggtgacactgtcttcgatcgacacccagagcaacgcgggctcggagatttcagtcacctcgaagagactgaacagcatgtccctgaacctgaaaggccggagcttggacaaggagaacgaggaggattgatccatccaccaacggacaaagcagctgtcgtaggtctggtgcagtactaccacgcgttcaaagcagcatctctgtatttacggaatttacggaggaagacgcggtttatctctttcataaactccacacatgtcacatgtgagagagctctggcactaggtcaccgcttctatcatcattatcatccttagtttagtttagtgcgtaagttttgtacacatccaatcgatgtccagttcctaatttccttgtctctagtttgtacccataaattagtaatataagtacttatatcagcacgcg

SEQ ID NO: 125 - protein, 428 aa, Zea mays
  misc_feature: Ceres CLONE ID no.236071
  misc_feature: Score of 873.4 for HMM of FIGURE 3.
  misc_feature: Functional Homolog Of Ceres SEEDLINE ID no. ME19173 at SEQ ID NO. 109
  misc_feature (82)..(102): Pfam Name: IQ Pfam Description: IQ calmodulin-binding motif
MGASGKWIKSLVALKAPEKAAGHKGGRKWRLWRSSSATSRASAGEGSALASESSSASADSFNSVLAAVVRAPPRDFLLIRQEWAAVRIHTAFRGFLARRALKALRGIVRLQALVRGRRVRKQLAVTLKCMHALLRVQERARERRARSSADGHGSQGQDALNGCASSTKDAMEQWCDRHGSVAEVRSNLHMKHEGAAKRERAIAYAVSHQPRGSRQKGRPSSPANCVRSHDPNGCDQDFSYLDGWMATKPWETRSTERNHSDSQLAKHEELNLPASKLSDASSVKIRRNNVTTRVSAAKRPPPSSVLSAASSDSACGGESSRSRPSVTLTSATTNTVLASEARSDSGDTGGPNYMSLTKSAKARLSGCSGSSHHRSFQRPRSGDMSRVTLSSIDTQSNAGSEISVTSKRLNSMSLNLKGRSLDKENEED

SEQ ID NO: 126 - protein, 455 aa, Oryza sativa subsp. indica
  misc_feature: Public GI ID no.125524760
  misc_feature: Score of 926.5 for HMM of FIGURE 3.
  misc_feature: Functional Homolog Of Ceres SEEDLINE ID no. ME19173 at SEQ ID NO. 109
  misc_feature (109)..(129): Pfam Name: IQ Pfam Description: IQ calmodulin-binding motif
MGGSGKWVKSLIGLKKPDREDCKEKLQVPSVNGGGGGKGRKWKLWRSSSGDHGSLWRGSRGGGGGGGHHRSASSDASDDASSAAGDPFTAAVATVARAPAKDFMAVRQEWAAIRVQTAFRGFLARRALRALKGLVRLQAIVRGRQVRKQAAVTLRCMQALVRVQARIRARRVRMSTEGQAVQKLLEARRTKLDILREAEEGWCDSQGTLEDVRVKLQKRQEGAIKRERAIAYAYSQQIEGATKCNFWTKCVIFLVFAQQQPKPTSYGRLNQSGMLLKHQHFDKSNGNWSWLERWMAARPWENRLMEEHNQTNSSSPDLLSSKNCEDSFGILGDFSEPNSVKVRKNNVSKRVCAKPPVVSHHQRIKAQSISSLSTELHNDESSASSSSCFASTPISFSTFVTTEKTEDSIRARPNYMNMTESIKAKRKACNAQRTTAGKLMEDRKASGVELKVAQV

SEQ ID NO: 127 - protein, 455 aa, Oryza sativa subsp. japonica
  misc_feature: Public GI ID no.125569365
  misc_feature: Score of 926.7 for HMM of FIGURE 3.
  misc_feature: Functional Homolog Of Ceres SEEDLINE ID no. ME19173 at SEQ ID NO. 109
  misc_feature (109)..(129): Pfam Name: IQ Pfam Description: IQ calmodulin-binding motif
MGGSGKWVKSLIGLKKPDREDCKEKLQVPSVNGRGGGKGRKWKLWRSSSGDHGSLWRGSRGGGCCGGHHRSASSDASDDASSAAADPFTAAVATVARAPAKDFMAVRQEWAAIRVQTAFRGFLARRALRALKGLVRLQAIVRGRQVRKQAAVTLRCMQALVRVQARIRARRVRMSTEGQAVQKLLEARRTKLDILREAEEGWCDSQGTLEDVRVKLQKRQEGAIKRERAIAYAYSQQIEGATKCNFWTECVIFLVFAQQQPKPTSYGRLNQSGMLLKHQHFDKSNGNWSWLERWMAARPWENRLMEEHNQTNSSSPDLLSSKNCEDSFGILGDFSEPNSVKVRKNNVSKRVCAKPPVVSHHQRIKAQSISSLSTELHNDESSASSSSCFASTPISFSTFVTTEKTEDSIRARPNYMNMTESIKAKRKACNAQRTTAGKLMEDRKASGVELKVAQV

SEQ ID NO: 128 - protein, 441 aa, Oryza sativa subsp. japonica
  misc_feature: Public GI ID no.115439499
  misc_feature: Score of 617.2 for HMM of FIGURE 3.
  misc_feature: Functional Homolog Of Ceres SEEDLINE ID no. ME19173 at SEQ ID NO. 109
  misc_feature (87)..(107): Pfam Name: IQ Pfam Description: IQ calmodulin-binding motif
MGASGKWIRTLVGLRPAAEREKERGGGGGKGRKWSRLWRSSSSQRGGGNASASEVYSETSSSADALSSVVAAVVRAPPRDFRLIRQEWAAVRIQTAFRAFLARRALRALRGIVRLQALVRGRRVRKQLAVTLKCMQALVRVQARARDRRARISADGLDSQDMLDERGGRVDHVKEAEAGWCDSQGTADDVRSKIHMRHEGAIKRERARTYAQSHQRCSNHGGRPSSPAVSLKHHGNGATRSNHSWSYLEGWMATKPWESRLMEQTHTENSTNSRCSESVEEVSVGGPKLSDASSVKIRRNNVTTRVAAKPPSMISATSSDFVCDESSPSTSSVTPLSANNSLATERRSDCGQVGGPSYMSLTKSAKARLSGYGSHKPPLQRQRSGDLLHHNNRMAFSSIDVQSTAGSEVSVTSKRLNSLALKGRATRSLDKENERRPSSLL

SEQ ID NO: 129 - protein, 416 aa, Arabidopsis thaliana; identical to SEQ ID NO: 109
  misc_feature: Public GI ID no.15225258
  misc_feature: Score of 954.4 for HMM of FIGURE 3.
  misc_feature: Functional Homolog Of Ceres SEEDLINE ID no. ME19173 at SEQ ID NO. 109
  misc_feature (84)..(104): Pfam Name: IQ Pfam Description: IQ calmodulin-binding motif

SEQ ID NO: 130 - protein, 408 aa, Oryza sativa subsp. japonica
  misc_feature: Public GI ID no.115465173
  misc_feature: Score of 554.2 for HMM of FIGURE 3.
  misc_feature: Functional Homolog Of Ceres SEEDLINE ID no. ME19173 at SEQ ID NO. 109
  misc_feature (79)..(99): Pfam Name: IQ Pfam Description: IQ calmodulin-binding motif
MGASGKWIKSLVSLKAAPEGTTKGRRWTRLWRSSSSASASASTAGDASESASSEADAFSSVVAAVVRAPPRDFRVIRQEWAAVRVQAAFRAFLARRALKALRGIVRLQALVRGRLVRRQLAVTLKCMNALLRVQERARERRARCSADGRDSQDAVGERDGRADPIKQAEEQWCDSQGSVSEVRSKIHMRHDAVAKRERAIAYALSHQPRSSKQSARPSSPARSLRNHESNRCNHDWSYIEGWMATKPWESRLMEQSHAELKCSKNSGELNLAGAQLSNASSVKMRGNRVAAKPPSVLSASSSDFPCDVSSASTSSATPARSDGGHGEGPSYMSLTKSAKARQSCNSPFQIQRQRSGGMSSYKRVALSPLDVQSNACSEFSVTSRKLNSLSLKGRSMTRSLDKENDNLF

SEQ ID NO: 131 - DNA, 1164 bp, Populus balsamifera subsp. trichocarpa
  misc_feature: Ceres ANNOT ID no.1477059
  misc_feature: Encodes the peptide sequence at SEQ ID NO 132
atgggtgcatcaggaaaatgggtgaaatcccttataggttttaaaaagtctgataaagatcaagaccatgtaaatggcaagagcaagaaatggaagctatggaggagctcatctggtgacttggggtcttcatggaaggattttaaagggaaacatagaacagcgtcagaggcatcgggttcttcaccattaactgatccatttactaccgcaatggctactgtggttagagctcctcctaagggttttagggttgtcaggcaagagtgggctgctatcaggattcaaactgctttccgtggattcttggcaagaagggctctgagggctttgaaagcagtggtgagactccaagctatagttcgaggtcgacaagtgagaaagcaggctgctgtgatgctttggtgtatgcaggctcttgttcgagttcaagctcgagtcagggctcatcctgtgcgaatgtccatagaagggcaggcagtgcagaatatgctaaatgagcgacatagcaaggctgatctcttgaaacatgctgaggaagggtggtgcgatggcaaggggacattggaagatgtgaagtcaaaactgcaaatgaggcaagaaggagccttcaagagagaaagagcaattgcatactcccttgctcagaaacaatggagatcaaaccccagctcaaatactcgaaccaatagctcagtatactcattcaagaatcaggagtttgataagaatagctggggatggactaggcctccaattgggcatattactcgctcatcttccagtccaagttctgaattccgctttgatgagagttcagcttcttcatcaatttgtacatctacaacaccaatatcaggaaacactggcttggcctctgataaaacagaggagagtggtaacagtaggccaaattacatgaacctgaccgagtcaaccaaggcaaagcaaaaaacatccggtcatttatctcataggatccaaaggcagtctatggatgagtttcagtttctcaaaaagtcaggagcattctcaaatggagattcgaaaaacagtactggttctgatccgtcagttaatttatctaagccactttgcttgccaacaagatttgataagaactcgacgaaacaactaagaggaatggatcatttgtatgattag

SEQ ID NO: 132 - protein, 387 aa, Populus balsamifera subsp. trichocarpa
  misc_feature: Ceres ANNOT ID no.1477059
  misc_feature: Score of 765.3 for HMM of FIGURE 3.
  misc_feature: Functional Homolog Of Ceres SEEDLINE ID no. ME19173 at SEQ ID NO. 109
  misc_feature (89)..(109): Pfam Name: IQ Pfam Description: IQ calmodulin-binding motif
MGASGKWVKSLIGFKKSDKDQDHVNGKSKKWKLWRSSSGDLGSSWKDFKGKHRTASEASGSSPLTDPFTTAMATVVRAPPKGFRVVRQEWAAIRIQTAFRGFLARRALRALKAVVRLQAIVRGRQVRKQAAVMLWCMQALVRVQARVRAHPVRMSIEGQAVQNMLNERHSKADLLKHAEEGWCDGKGTLEDVKSKLQMRQEGAFKRERAIAYSLAQKQWRSNPSSNTRTNSSVYSFKNQEFDKNSWGWTRPPIGHITRSSSSPSSEFRFDESSASSSICTSTTPISGNTGLASDKTEESGNSRPNYMNLTESTKAKQKTSGHLSHRIQRQSMDEFQFLKKSGAFSNGDSKNSTGSDPSVNLSKPLCLPTRFDKNSTKQLRGMDHLYD

SEQ ID NO: 133 - DNA, 1059 bp, Populus balsamifera subsp. trichocarpa
  misc_feature: Ceres ANNOT ID no.1530547
  misc_feature: Encodes the peptide sequence at SEQ ID NO 134
atgggtgcatcaggaaaatgggtgaaatcccttataggttttaaaaagtctgataaagatcaagaccatgtaaatggcaagagcaagaaatggaagctatggaggagctcatctggtgacttggggtcttcatggaaggattttaaagggaaacatagaacagcgtcagaggcatcgggttcttcaccattaactgatccatttactaccgcaatggctactgtggttagagctcctcctaagggttttagggttgtcaggcaagagtgggctgctatcaggattcaaactgctttccgtggattcttggctcttgttcgagttcaagctcgagtcagggctcatcctgtgcgaatgtccatagaagggcaggcagtgcagaatatgctaaatgagcgacatagcaaggctgatctcttgaaacatgctgaggaagggtggtgcgatggcaaggggacattggaagatgtgaagtcaaaactgcaaatgaggcaagaaggagccttcaagagagaaagagcaattgcatactcccttgctcagaaacaatggagatcaaaccccagctcaaatactcgaaccaatagctcagtatactcattcaagaatcaggagtttgataagaatagctggggatggactaggcctccaattgggcatattactcgctcatcttccagtccaagttctgaattccgctttgatgagagttcagcttcttcatcaatttgtacatctacaacaccaatatcaggaaacactggcttggcctctgataaaacagaggagagtggtaacagtaggccaaattacatgaacctgaccgagtcaaccaaggcaaagcaaaaaacatccggtcatttatctcataggatccaaaggcagtctatggatgagtttcagtttctcaaaaagtcaggagcattctcaaatggagattcgaaaaacagtactggttctgatccgtcagttaatttatctaagccactttgcttgccaacaagatttgataagaactcgacgaaacaactaagaggaatggatcatttgtatgattag

SEQ ID NO: 134 - protein, 352 aa, Populus balsamifera subsp. trichocarpa
  misc_feature: Ceres ANNOT ID no.1530547
  misc_feature: Score of 607.6 for HMM of FIGURE 3.
  misc_feature: Functional Homolog Of Ceres SEEDLINE ID no. ME19173 at SEQ ID NO. 109
  misc_feature (89)..(109): Pfam Name: IQ Pfam Description: IQ calmodulin-binding motif
MGASGKWVKSLIGFKKSDKDQDHVNGKSKKWKLWRSSSGDLGSSWKDFKGKHRTASEASGSSPLTDPFTTAMATVVRAPPKGFRVVRQEWAAIRIQTAFRGFLALVRVQARVRAHPVRMSIEGQAVQNMLNERHSKADLLKHAEEGWCDGKGTLEDVKSKLQMRQEGAFKRERAIAYSLAQKQWRSNPSSNTRTNSSVYSFKNQEFDKNSWGWTRPPIGHITRSSSSPSSEFRFDESSASSSICTSTTPISGNTGLASDKTEESGNSRPNYMNLTESTKAKQKTSGHLSHRIQRQSMDEFQFLKKSGAFSNGDSKNSTGSDPSVNLSKPLCLPTRFDKNSTKQLRGMDHLYD

SEQ ID NO: 135 - DNA, 1923 bp, Arabidopsis thaliana
  misc_feature: Ceres SEEDLINE ID no.ME24091
  misc_feature: Encodes the peptide sequence at SEQ ID NO. 136
acaaatactcttcttcacacagctttgaatccatctgtcttctcctctctctctcttctccatttgcaattacgataatgtgaaagcaataagaagaggaaaagttatcttcgcacctcagcaaagatccaatcgattcgattcttaagctttttcgtcttctccgataaggtcactacttagaagccgcgttgtggtttagttgactcctccaggttttatcttcaagctttttcgtctatcagatctggtgtcactgtcttctcataggattacatagagatggggaaaaaagctaaatggttttcaagtgttaagaaagcattcagcccagattcaaagaagtcgaagcaaaaattggctgagggacaaaatggtgttatctctaatcctcctgttgtggataatgttagacaatcttcttcttctcctcctcctgctcttgctcctcgtgaagtgagagtagctgaagtgattgttgaacggaacagggatctttcacctccttctacagcagatgctgtgaatgttacagctactgatgtycctgtagttccatcttcatctgctcctggtgttgttcgtcgcgctacacctactcgatttgctggaaagtcaaacgaagaagccgctgctatcttgatccagactatatttagaggttatttggcaaggagagcgttgcgggcaatgaggggtttggtcagacttaagttattgatggaaggatctgttgttaagcggcaagctgcaaatactctaaaatgtatgcagactctctctcgtgtacagtcgcagatccgagctaggagaatcaggrtgtcagaagagaatcaggctcgccagaaacaactccttcagaaacatgctaaagagctagctggcttgaagaacggggataactggaatgatagcattcaatcaaaggagaaagttgaagcgaatttgctaagcaagtacgaggcaacaatgagaagggaaagggcattggcttattcatactctcatcascaaaactggaagaacaactctaaatctggaaacccgatgttcatggatccaagcaacccgacatggggttggagctggttggagagatggatggctggtaggccactagagagttccgagaaagaacaaagcaacagcaacaatgacaatgctgcctcggtcaagggctctattaaccgcaacgaagctgcaaaatctctaacccgcaatggctcaactcaaccaaacacaccatcatccgcaagagggaccccaagaaacaaaaacagtttcttctcacctccaactccctcaaggctaaaccaatcctcgaggaaatccaatgacgacgactccaaaagcacaatctcggtcctgtccgagaggaaccgcagacacascattgctggttcatcagtcasagacgatgagagcctcgctggctcaccagctctcccgagctacatggttccaactaaatcagctcgagccaggctcaagccccaaagcccattaggtggtaccacacaggaaaacgaagggttcacagacaaggcatcagctaagaaacggctctcgtatccaacttcgcctgcattgcctaaaccacggcggttctcagctccccctaaggtggagagtggcggcgttaccgtgaccaacggagcaggcagctgaggtattttatttaatataattattttcccacttatgaatgtgtccgagattgttgtctcttatgtgttcccttcatttcgtaattcatttgtgcagtgtaagcgccagtcatttatttttttactataataaattttataaccttttaaaattcatgttcttttgtttctttgaatatttaagttatttttattaatgttggatgaattggaatatgatgatgttatttgtattgtaatgcagatcctttaaagc

SEQ ID NO: 136 - protein, 461 aa, Arabidopsis thaliana
  misc_feature: Ceres SEEDLINE ID no.ME24091
  misc_feature: Score of 1104.8 for HMM of FIGURE 4.
  misc_feature (88)..(88): Xaa is any aa, unknown, or other
  misc_feature (115)..(135): Pfam Name: IQ Pfam Description: IQ calmodulin-binding motif
  misc_feature (180)..(180): Xaa is any aa, unknown, or other
  misc_feature (243)..(243): Xaa is any aa, unknown, or other
  misc_feature (370)..(370): Xaa is any aa, unknown, or other
  misc_feature (377)..(377): Xaa is any aa, unknown, or other
MGKKAKWFSSVKKAFSPDSKKSKQKLAEGQNGVISNPPVVDNVRQSSSSPPPALAPREVRVAEVIVERNRDLSPPSTADAVNVTATDXPVVPSSSAPGVVRRATPTRFAGKSNEEAAAILIQTIFRGYLARRALRAMRGLVRLKLLMEGSVVKRQAANTLKCMQTLSRVQSQIRARRIRXSEENQARQKQLLQKHAKELAGLKNGDNWNDSIQSKEKVEANLLSKYEATMRRERALAYSYSHXQNWKNNSKSGNPMFMDPSNPTWGWSWLERWMAGRPLESSEKEQSNSNNDNAASVKGSINRNEAAKSLTRNGSTQPNTPSSARGTPRNKNSFFSPPTPSRLNQSSRKSNDDDSKSTISVLSERNRRHXIAGSSVXDDESLAGSPALPSYMVPTKSARARLKPQSPLGGTTQENEGFTDKASAKKRLSYPTSPALPKPRRFSAPPKVESGGVTVTNGAGS

SEQ ID NO: 137 - DNA, 1930 bp, Zea mays
  misc_feature: Ceres CLONE ID no.375578
  exon (223)..(1716): Encodes the peptide sequence at SEQ ID NO 138
aattcgagtgagcttattggagactgacatcctaatcgaaaacccggtttattttttcttcgtcctggatgcgtcggtcgcgtgtttgatctgactaagccgcggaggagggtgctagatgtccgtgcggtgggcggtggctcccgagggcgaccggagttaggtccttgccgccttcagtgcggtggggaagcgagacattgaaggcgcagaacccaaagaatgggtaagagaggaaagtggtttagtgcggtgaagaaagtcttcagctcctccgatccagatggaaaggaagccaaggcccagaaggcagacaaatcgaaatccaagaggagatggccatttggaaagtccaagcactcggagccttccatatcgacggtgccaggcactgctccagcagtagctccgttgccatcaccaccagcaactcagccccactctctggagatcaaagatgtcaatccagttgaaacagacagtgagcagaacaagcatgcctactccgttgcgcttgcgtctgctgtcgctgctgaagctgcagcagttgctgcccaggctgctgcggaagttgtccgcctcacagcagttaccacggctgcaccaaagatgcctgttagttcgagggaagaacttgccgccaccaagattcagactgccttcaggggttatctggcaaggagagcattgcgtgcactaagagggctagttagattgaagtcgcttgttgatggaaatgctgtcaaacgccaaaccgctcacaccttgcaatgcacacaagcaatgacaagagttcaaactcaaatctactctagaagggtgaagttggaggaggagaaacaggctcttcaaagacaactccaattgaaacatcaaagggaacttgagaaaatgaagattgatgaagattgggatcacagccatcaatccaaagagcaaattgaggccaacctaatgatgaaacaggaagctgcactgaggcgagagagagcacttgcatatgcattttctcaccagtggaggaattctggtcgaactataacccctacttttacggaacctgggaaccccaactggggctggagctggatggagcgctggatgacagcaagaccatgggagagtcggttggcggcggcatcggacaaggaccctaaagaacgtgctgtgacaaagaatgcgagcaccagtgctgttcgagtacctgtatcccgtgccatctcgattcagagaccagcaacaccaaacaagtcgagccgcccaccaagccggcagtcactttcaaccccgccatcgaagaccccgtcagcctcaggaaaggccaggccggcaagtccaaggaacagttggctgtacaaggaggatgacctgaggagcatcacgagcatccgctccgagcgcccaaggaggcagagcacgggtggaggctcggtccgggacgataccagcctgaccagcacaccacctctccccagctacatgcagtcgaccgagtctgcacgggccaagtctcggtaccgcagtctactactgactgagaagcttgaggttcctgagagagcgcctctggcccactccgttgtcaagaagcgcctgtcgttccccgtcgtcgagaagccaagcgttgtgccgacagagaagcccagggaaagagtgaggcgccattccgaccctccgaaggtcgatcctgcgacgctcaaggatgcccctgctgcctgaccagtgaccaggccttatgtgattgttaggtttcgtgctcttttaacaccgtgatgtattatctgagttaggttgctttgttcgtgtcatcgtatgatctgtccgggttgattttgagacagttctaactgtgtttacagacaatgcgtgatgctaaatgtatgtgtggttggttggctttaaatgtactgatatgatagtatttgatttc

SEQ ID NO: 138 - protein, 498 aa, Zea mays
  misc_feature: Ceres CLONE ID no.375578
  misc_feature: Score of 1275.4 for HMM of FIGURE 4.
  misc_feature: Functional Homolog Of Ceres SEEDLINE ID no. ME24091 at SEQ ID NO. 136
  misc_feature (137)..(157): Pfam Name: IQ Pfam Description: IQ calmodulin-binding motif
MGKRGKWFSAVKKVFSSSDPDGKEAKAQKADKSKSKRRWPFGKSKHSEPSISTVPGTAPAVAPLPSPPATQPHSLEIKDVNPVETDSEQNKHAYSVALASAVAAEAAAVAAQAAAEVVRLTAVTTAAPKMPVSSREELAATKIQTAFRGYLARRALRALRGLVRLKSLVDGNAVKRQTAHTLQCTQAMTRVQTQIYSRRVKLEEEKQALQRQLQLKHQRELEKMKIDEDWDHSHQSKEQIEANLMMKQEAALRRERALAYAFSHQWRNSGRTITPTFTEPGNPNWGWSWMERWMTARPWESRLAAASDKDPKERAVTKNASTSAVRVPVSRAISIQRPATPNKSSRPPSRQSLSTPPSKTPSASGKARPASPRNSWLYKEDDLRSITSIRSERPRRQSTGGGSVRDDTSLTSTPPLPSYMQSTESARAKSRYRSLLLTEKLEVPERAPLAHSVVKKRLSFPVVEKPSVVPTEKPRERVRRHSDPPKVDPATLKDAPAA

SEQ ID NO: 139 - DNA, 1930 bp, Zea mays
  misc_feature: Ceres CLONE ID no.375578
aattcgagtgagcttattggagactgacatcctaatcgaaaacccggtttattttttcttcgtcctggatgcgtcggtcgcgtgtttgatctgactaagccgcggaggagggtgctagatgtccgtgcggtgggcggtggctcccgagggcgaccggagttaggtccttgccgccttcagtgcggtggggaagcgagacattgaaggcgcagaacccaaagaatgggtaagagaggaaagtggtttagtgcggtgaagaaagtcttcagctcctccgatccagatggaaaggaagccaaggcccagaaggcagacaaatcgaaatccaagaggagatggccatttggaaagtccaagcactcggagccttccatatcgacggtgccaggcactgctccagcagtagctccgttgccatcaccaccagcaactcagccccactctctggagatcaaagatgtcaatccagttgaaacagacagtgagcagaacaagcatgcctactccgttgcgcttgcgtctgctgtcgctgctgaagctgcagcagttgctgcccaggctgctgcggaagttgtccgcctcacagcagttaccacggctgcaccaaagatgcctgttagttcgagggaataacttgccgccaccaagattcagactgccttcaggggttatctggcaaggagagcattgcgtgcactaagagggctagttagattgaagtcgcttgttgatggaaatgctgtcaaacgccaaaccgctcacaccttgcaatgcacacaagcaatgacaagagttcaaactcaaatctactctagaagggtgaagttggaggaggagaaacaggctcttcaaagacaactccaattgaaacatcaaagggaacttgagaaaatgaagattgatgaagattgggatcacagccatcaatccaaagagcaaattgaggccaacctaatgatgaaacaggaagctgcactgaggcgagagagagcacttgcatatgcattttctcaccagtggaggaattctggtcgaactataacccctacttttacggaacctgggaaccccaactggggctggagctggatggagcgctggatgacagcaagaccatgggagagtcggttggcggcggcatcggacaaggaccctaaagaacgtgctgtgacaaagaatgcgagcaccagtgctgttcgagtacctgtatcccgtgccatctcgattcagagaccagcaacaccaaacaagtcgagccgcccaccaagccggcagtcactttcaaccccgccatcgaagaccccgtcagcctcaggaaaggccaggccggcaagtccaaggaacagttggctgtacaaggaggatgacctgaggagcatcacgagcatccgctccgagcgcccaaggaggcagagcacgggtggaggctcggtccgggacgataccagcctgaccagcacaccacctctccccagctacatgcagtcgaccgagtctgcacgggccaagtctcggtaccgcagtctactactgactgagaagcttgaggttcctgagagagcgcctctggcccactccgttgtcaagaagcgcctgtcgttccccgtcgtcgagaagccaagcgttgtgccgacagagaagcccagggaaagagtgaggcgccattccgaccctccgaaggtcgatcctgcgacgctcaaggatgcccctgctgcctgaccagtgaccaggccttatgtgattgttaggtttcgtgctcttttaacaccgtgatgtattatctgagttaggttgctttgttcgtgtcatcgtatgatctgtccgggttgattttgagacagttctaactgtgtttacagacaatgcgtgatgctaaatgtatgtgtggttggttggctttaaatgtactgatatgatagtatttgatttc

SEQ ID NO: 140 - protein, 311 aa, Zea mays
  misc_feature: Ceres CLONE ID no.375578
  misc_feature: Score of 653.4 for HMM of FIGURE 4.
  misc_feature: Functional Homolog Of Ceres SEEDLINE ID no. ME24091 at SEQ ID NO. 136
MTRVQTQIYSRRVKLEEEKQALQRQLQLKHQRELEKMKIDEDWDHSHQSKEQIEANLMMKQEAALRRERALAYAFSHQWRNSGRTITPTFTEPGNPNWGWSWMERWMTARPWESRLAAASDKDPKERAVTKNASTSAVRVPVSRAISIQRPATPNKSSRPPSRQSLSTPPSKTPSASGKARPASPRNSWLYKEDDLRSITSIRSERPRRQSTGGGSVRDDTSLTSTPPLPSYMQSTESARAKSRYRSLLLTEKLEVPERAPLAHSVVKKRLSFPVVEKPSVVPTEKPRERVRRHSDPPKVDPATLKDAPAA

SEQ ID NO: 141 - protein, 217 aa, Arabidopsis thaliana
  misc_feature: Ceres SEEDLINE ID no.ME10681
  misc_feature: Score of 322.9 for HMM of FIGURE 4.
  misc_feature: Functional Homolog Of Ceres SEEDLINE ID no. ME24091 at SEQ ID NO. 136
MGKKGKWFGAVKKVFSPESKEKKEESNIDRGSVKSMSLNLGEGEITKAFNRRDSKLEKPSPPTPRPARPTSRHSPLTPSARVAPIPARRKSVTPKNGLSQVDDDARSVLSVQSERPRRHSIATSTVRDDESLTSSPSLPSYMVPTESARAKSRLQGSAMANGAETPEKGGSTGPAKKRLSFQGGTAAASPMRRHSGPPKVEIAPPQPEALVVNGGSK

SEQ ID NO: 142 - protein, 311 aa, Arabidopsis thaliana; identical to SEQ ID NO: 140
  misc_feature: Ceres SEEDLINE ID no.ME03140
  misc_feature: Score of 653.4 for HMM of FIGURE 4.
  misc_feature: Functional Homolog Of Ceres SEEDLINE ID no. ME24091 at SEQ ID NO. 136

SEQ ID NO: 143 - protein, 421 aa, Arabidopsis thaliana
  misc_feature: Ceres SEEDLINE ID no.ME24076
  misc_feature: Score of 908.3 for HMM of FIGURE 4.
  misc_feature: Functional Homolog Of Ceres SEEDLINE ID no. ME24091 at SEQ ID NO. 136
  misc_feature (60)..(80): Pfam Name: IQ Pfam Description: IQ calmodulin-binding motif
LEVNLSVPPPPAPPPVLHQAEEVGVPEAEQEQSKHVAVEEAPAAAPAQASVLPPAVPTQELAAVKIQTAFRGYLARRALRALRGLVRLKSLVEGNSVKRQSASTLRCMQTLSRVQSQISSRRAKMSEENQALQRQLLLKQELENFRMGENWDDSTQSKEQIEASLISRQEAAIRRERALAYAFSHQWKSTSRSVNPMFVDPNNLQWGWSWLERWMAAKPWEGRNGADKESNIDRGSVKSMSLNLGEGEITKAFNRRDSKLEKPSPPTPRPARPTSRHSPLTPSARVAPIPARRKSVTPKNGLSQVDDDARSVLSVQSERPRRHSIATSTVRDDESLTSSPSLPSYMVPTESARAKSRLQGSAMANGAETPEKGGSTGPAKKRLSFQGGTAAASPMRRHSGPPKVEIAPPQPEALVVNGGSK

SEQ ID NO: 144 - protein, 311 aa, Oryza sativa subsp. japonica; identical to SEQ ID NO: 140
  misc_feature: Ceres SEEDLINE ID no.ME24217
  misc_feature: Score of 653.4 for HMM of FIGURE 4.
  misc_feature: Functional Homolog Of Ceres SEEDLINE ID no. ME24091 at SEQ ID NO. 136

SEQ ID NO: 145 - protein, 500 aa, Oryza sativa subsp. japonica
  misc_feature: Public GI ID no.115440873
  misc_feature: Score of 1281.0 for HMM of FIGURE 4.
  misc_feature: Functional Homolog Of Ceres SEEDLINE ID no. ME24091 at SEQ ID NO. 136
  misc_feature (142)..(162): Pfam Name: IQ Pfam Description: IQ calmodulin-binding motif
MGKKGNWFSAVKKVFSSSDPDGREAKIEKADKSRSRRKWPFGKSKKSDPWTSTVAVPTSTAPPPQPPPPPPTHPIQPQPEEIKDVKAVETDSEQNKHAYSVALASAVAAEAAAVAAQAAAEVVRLTTATTAVPKSPVSSKDELAAIKIQTAFRGYLARRALRALRGLVRLKSLVDGNAVKRQTAHTLHCTQTMTRVQTQIYSRRVKMEEEKQALQRQLQLKHQRELEKMKIDEDWDHSHQSKEQVETSLMMKQEAALRRERALAYAFSHQWKNSGRTITPTFTDQGNPNWGWSWMERWMTSRPWESRVISDKDPKDHYSTKNPSTSASRTYVPRAISIQRPATPNKSSRPPSRQSPSTPPSRVPSVTGKIRPASPRDSWLYKEDDLRSITSIRSERPRRQSTGGASVRDDASLTSTPALPSYMQSTESARAKSRYRSLLTDRFEVPERVPLVHSSIKKRLSFPVADKPNGEHADKLMERGRRHSDPPKVDPASLKDVPVS

SEQ ID NO: 146 - DNA, 1695 bp, Triticum aestivum
  misc_feature: Ceres CLONE ID no.826796
  misc_feature: Encodes the peptide sequence at SEQ ID NO 147
ataggacttcacagacagactgactcaatcctaacccaatccctcccatgcttccatctactctagcagaaattgcagaggaggttggccgccgccggctccagcgcaggcgcagcctacccgcgggatctgacgccctccgcctcctacctcgaggcacgcgcctcaggctcagctcccccgcccgccctcccccgctaccccgacgacttccaagaggaggagcatgaaattgagcatgtcgccgccgcgccagcgccagcgccagccacggatgcgccgctacctgcccctcctgccgccgcaccaccacaggttcaggctgccattgcgccggcttcttcctcttgtgtcatgtccagggagctcgccgccaccaagatccagaccgccttccgaggtcacctggcaagaagggcgctgcgggcattgaaaggcctggtcagactcaagtcgctggtccaaggccactccgtcaagcgccaggccaccagcacgcttcgctgcatgcagactctgtcccgggtccagtccaagatacggacgaggaggatcaagatggccgaggagaaccaggcccttcagcgccagctcttgttgaaccaggaactagagactctcaggatgggagatcagtggaataccagcctgcagtccaaggagcaaatcgaggcgagcctcgtgagcaggcaagaggccgcggctagaagagaacgggctctcgcatacgcattctcccaccagtggaagagcacctcaaggtctgccaacccgatgttcgtggacccgagtaacccgcactggggctggagctggctggagcggtggatggcgtcgaggccgttcgacggccgcaacggggcgtccgagaaggagggcagcagcgtcgaccgcacgtcggtgcacagcaccagcctgagcatgaacctcggagaaggtgagacggtcacaaaggcggacaaccaggtggtggactctttgaagccgaatgatgataagccgccgccgctttcgactccgaagccgtccggccctgcccccaggcagtccccgtcgacgccctcgccggcgctggcgaggaagaagagcgcgacgcccaagagtggagactgcgacggcgacgacgcgaggagcgtggtcagcactgtccggtccgagcggccccggaggcacagcatcggcgcgtccagcgtgcgtgacgacgcgggctcttccccgtcggtgccgagctacatggcggccaccaagtcggcgtcggccagggccaagtcgcgtgtgcagagcccgacgctgaccgagggtgctgctcaagctgagacgctggagaaaggatggtcttctgtgggttcagcgaagaagcggctgtcctttccggctgggacgccaccgccggtgccggcggcggcggcgaggcggcactccgggcctcccaaggtgcggcaggcgggcgtggaaggtggtacggaggaacgggactcgtcccttgcgtgacatcatgggaagcagattatggtgtggagcagagcagagcggaatttgttgcatttgttgagtgaaaggaacgcagaatgtgtgttgtgtggatccattggatttgatttgatttgtatgatggcagtattcctatttgattattcattgaataatataagtatctgtaatgaagataaaaggaggggacacgaacattatttc

SEQ ID NO: 147 - protein, 378 aa, Triticum aestivum
  misc_feature: Ceres CLONE ID no.826796
  misc_feature: Score of 903.8 for HMM of FIGURE 4.
  misc_feature: Functional Homolog Of Ceres SEEDLINE ID no. ME24091 at SEQ ID NO. 136
  misc_feature (4)..(24): Pfam Name: IQ Pfam Description: IQ calmodulin-binding motif
MSRELAATKIQTAFRGHLARRALRALKGLVRLKSLVQGHSVKRQATSTLRCMQTLSRVQSKIRTRRIKMAEENQALQRQLLLNQELETLRMGDQWNTSLQSKEQIEASLVSRQEAAARRERALAYAFSHQWKSTSRSANPMFVDPSNPHWGWSWLERWMASRPFDGRNGASEKEGSSVDRTSVHSTSLSMNLGEGETVTKADNQVVDSLKPNDDKPPPLSTPKPSGPAPRQSPSTPSPALARKKSATPKSGDCDGDDARSVVSTVRSERPRRHSIGASSVRDDAGSSPSVPSYMAATKSASARAKSRVQSPTLTEGAAQAETLEKGWSSVGSAKKRLSFPAGTPPPVPAAAARRHSGPPKVRQAGVEGGTEERDSSLA

SEQ ID NO: 148 - DNA, 1470 bp, Populus balsamifera subsp. trichocarpa
  misc_feature: Ceres ANNOT ID no.1465047
  misc_feature: Encodes the peptide sequence at SEQ ID NO 149
atggggaaaagagggagttggttctctgctttgaagaaagccctcggttcctctaagaaatccaaatcaaagaagaaatggtcagaaaaagagaagaaccgggatctaggtgtttcttcacatgaagaaaccgttgcaccctctctttctcctcctcgtacaccacctcctcctacagcagaagatgtgaaattaactgaagctgagaacgagcagagcaagcatgcttattccgtggcgcttgccactgctgtggcagctgaggcagctgttgcagccgcccaggctgccgctgaggttgttcggcttactacagtggcacattactctggaaaatcgaaggaggaaatagctgcaatcaggattcaaacagcatttagaggatacctggcgaggagggcattacgtgctttgagagggctggtgagattgaagtcattgatacaagggcaatctgtcaaacggcaagcaactgccacattacgagccatgcagactcttgctcgtgtgcagtctcagattcgtgcaagaaggatcagaatgtccgaggaaaatgaggccctccaacggcagctccagcagaaacatgacaaagaacttgagaagttgagaacttctattggagaacaatgggatgatagcccacaatcaaaggaagaagttgaagccagcctactacaaaagcaagaagctgccatgagaagagaaagggcactggcttatgcatactcgcatcagcaaatgtggaagcaatcttcaaaatcagcaaatgctacattcatggatccaaacaatcctcgttggggatggagttggttagagaggtggatggcagcccgaccttgggagagccgaagcacaatagataacaatgatcgggcctctgttaagagtacaacaagccgtaccatgtctcttggagaaatcagcagagcttattctcgtcgtgatcttaaccatgacaataaagcttctcctggtgcgcaaaaatcaagtcggcctcccagtcggcaatcaccttctactcccccctctaaggcaccatctacatcttcagtaacagggaaagcaaagccaccaagccctagagggagtgcttggggaggagacgaggactccaggagcacattcagtgtccagtctgagcgctatcggagacatagcatagcagggtcatcaataagagatgatgagagtcttgcaagttcgccttcagttccaagttacatggcacccacacggtcacagtcagcaaaggcaaaatcccgcttgtcaagcccgttaggcatagataataatgggacaccagataaggcatcagtgggttatgtaaagaagcggctttccttctctgcttcaccagctggagcaaggagacactctggtcctcctagggtggatgccagtgctgttaaagacattcaaatgcacagagaagagaaaatgagcaatggagcaagcagcaagtag

SEQ ID NO: 149 - protein, 326 aa, Populus balsamifera subsp. trichocarpa
  misc_feature: Ceres ANNOT ID no.1465047
  misc_feature: Score of 746.5 for HMM of FIGURE 4.
  misc_feature: Functional Homolog Of Ceres SEEDLINE ID no. ME24091 at SEQ ID NO. 136
MQTLARVQSQIRARRIRMSEENEALQRQLQQKHDKELEKLRTSIGEQWDDSPQSKEEVEASLLQKQEAAMRRERALAYAYSHQQMWKQSSKSANATFMDPNNPRWGWSWLERWMAARPWESRSTIDNNDRASVKSTTSRTMSLGEISRAYSRRDLNHDNKASPGAQKSSRPPSRQSPSTPPSKAPSTSSVTGKAKPPSPRGSAWGGDEDSRSTFSVQSERYRRHSIAGSSIRDDESLASSPSVPSYMAPTRSQSAKAKSRLSSPLGIDNNGTPDKASVGYVKKRLSFSASPAGARRHSGPPRVDASAVKDIQMHREEKMSNGASSK

SEQ ID NO: 150 - DNA, 1901 bp, Gossypium hirsutum
  misc_feature: Ceres CLONE ID no.1919901
  misc_feature: Encodes the peptide sequence at SEQ ID NO 151
aacttttcttagttatcctctgcaaatgccaacctgttcttttattattattttccgccatttttgctctctttcaagcattttttttttgcctagatccacttctctctctttgatttttaattactgcatttttgttttaatacacaataagaacaactaagagatagaatgtgacttatcaatcttttaactgagatctgtgagaatttttctatgtaccaaggaattatttacagatgggaaaaaaaggtggctggctttctattgtgaagaaagctttgagccctgaatccaagaaatctcagcaccaaactccaaagccaaagaaaaaatggttcggaaaaagcaaaaatttgagccctgtgtctgtgcctgaagaaactgaagtgataactgaagatgcaaagctaaaagaagctgaaaacgaacaaagcaaacatgcctactctgtggctcttgccaccgctgtggcggccgaggcagcggtggcagctgctcaggcggctgctgaagttgtccgtctcacttctcagccgcgccatctggggaagtcaaaggaggaaatagctgctatcaggattcaaacagcatttcgtggatatttggctaggagggcactgcgagctttgagagggttggtaaggttgaaatcgttgatcagagggcaatccgtcaaacgccaagcaactacaacgttaagatgcatgcagactctagctcgtctgcagtctgagatttctgcaaggaggattagaatgtcagaagagaaccaggctcttcagcgccagcttcaacagaaatgccagaaagagctcgagaagttgagagctcccatgagagaagactggaacgatagtacacagtcgaaggagcagatcgaagcaagacaacaaaataagcaaggagctactatgaaaagggaaagagcattggcttatgcatactgtcaccagcgatcgtggaagaactgttctagatcagtgaatcaaacatttatggatccgagtaattcacactggggttggagttggttagagcgatggatggcagcccgaccatgggaagtccaaagcacaactgataacaatgaccgtggctcagtcaagagtatgggtgcttgttcgatatctataagtgaaatcagcagagcttattctcgaagagatcttaacaatgataacaaaccatctccaacacctcagaagtcaagtcgagttcctagccgccagtctccatcgactccaccttcaaaggcaccttcgatttcatcggtttctggtaaaacaagactgccaagtccgagaggaagtcaatggggagggtatgaagactcaaggagcatactcagtacccggtctgatcgttataggagacatagcattgcagggtcctcaatgagagacgatgagagccttacaagctcacctgcagttccaagttatatggcaccaacacagtccacaaaggccaggtcccacataccaagccccttaggaagtggcacaccagataggagagtggcagggtctgcaaagaaacggcttttgttcccagcatccccagccagtagtaggagacattcagagcctcctaaagtggacataagtgaggctagaaagaatcagcatgcaccaagcaatggaaggcaagtggcttggtgaagagtgcaacaaaagttagattgaataaacatggaagggttatttcaacttgaagttcttgtagtgtggttgtgattatctttttcttcctaggttttatgattattaattataaaagggttacttttttctgggtgagatttagtttattgtttgtggttgacaaacattcttaaaaatcttcaagtttagtttcaattcatgaaatttgtaattaaaaaaaaaaaaaaaaaaaaa

SEQ ID NO: 151 - protein, 474 aa, Gossypium hirsutum
  misc_feature: Ceres CLONE ID no.1919901
  misc_feature: Score of 1214.2 for HMM of FIGURE 4.
  misc_feature: Functional Homolog Of Ceres SEEDLINE ID no. ME24091 at SEQ ID NO. 136
  misc_feature (109)..(129): Pfam Name: IQ Pfam Description: IQ calmodulin-binding motif
MGKKGGWLSIVKKALSPESKKSQHQTPKPKKKWFGKSKNLSPVSVPEETEVITEDAKLKEAENEQSKHAYSVALATAVAAEAAVAAAQAAAEVVRLTSQPRHLGKSKEEIAAIRIQTAFRGYLARRALRALRGLVRLKSLIRGQSVKRQATTTLRCMQTLARLQSEISARRIRMSEENQALQRQLQQKCQKELEKLRAPMREDWNDSTQSKEQIEARQQNKQGATMKRERALAYAYCHQRSWKNCSRSVNQTFMDPSNSHWGWSWLERWMAARPWEVQSTTDNNDRGSVKSMGACSISISEISRAYSRRDLNNDNKPSPTPQKSSRVPSRQSPSTPPSKAPSISSVSGKTRLPSPRGSQWGGYEDSRSILSTRSDRYRRHSIAGSSMRDDESLTSSPAVPSYMAPTQSTKARSHIPSPLGSGTPDRRVAGSAKKRLLFPASPASSRRHSEPPKVDISEARKNQHAPSNGRQVAW

SEQ ID NO: 152 - DNA, 1362 bp, Glycine max
  misc_feature: Ceres CLONE ID no.520008
  misc_feature: Encodes the peptide sequence at SEQ ID NO 153
atgcattcactcatcaggtttttttaaaaaaaaaaaattctcatcaatttacacatgcgagaaaatgggtgaaaaatttaatacgaactgaaaaatctttcaaaaatatcgcatattataaacactaaaatgagaaatcaagcatccttattatactatatggatatactcttcactgtttctttatctcttgaatctgttatactttccaactgagacttaggcctgattcctgataagtgcacgagtcctttcctatcttgtcactatcttcagagccatatcctctgcactctcctttctcactgccacgatgatcttttgcataatccaatgatatgctaatgctttgttaagtaagttgcagcgtaaattcttcctcaattttgtcaatggaagtattttgttactgaaataaagtggcatgctatattatgtaacatattttgaatgaatagcattctgcctatgatatgattttcaatcataagtgtaagttccttgatgctgtcaacaaattcagtgtttgatatttgggggcaaaaaatatttggcagcaaaactggaagaactcgtctagatctgtaaatccaatgtttatggatccaactaatccgagctggggttggagctggttggaacgatggatggcagcccgaccttgggagagccgtagccatatggataaagagttgaatgaccactcctccataagaagctcaagccgcagcattaccggtggagaaatcagcaagtcatttgctcgtttccagctcaattcggaaaagcactctccaacagccagccagaatcctggctcccctagctttcagtccactccttccaagccagcttcatcatctgctaagaaaccaaagaaggtaagtccaagcccaaggggcagctgggttatggacgaggactccaaaagcttggtcagtgtacactctgaccggttccggaggcactccattgccggttcatcggtgagagatgacgagagccttgctagctctccagcagttccaagctacatggtgccaactcaatctgcaaaagccaagtccaggacacaaagtccattagcctcagaaaatgcaaaagcagagaaaggttcctttgggagtgcaaagaagcggctttctttcccagcttcacctgccaggccaaggcgccattcaggtccaccaaaggttgaaagcagcagcttaaatgcagagttagctgtggacaagggtgtggacagttgatcatacaagtaaaaggatggaaaagcattaaagtaggattgaaaatatatcactgaagaaataaaacaaaaagagtttatttaaaaaaaaaaaaaaaaaaaaaaaaaaaaaa

SEQ ID NO: 153 - protein, 218 aa, Glycine max
  misc_feature: Ceres CLONE ID no.520008
  misc_feature: Score of 156.2 for HMM of FIGURE 4.
  misc_feature: Functional Homolog Of Ceres SEEDLINE ID no. ME24091 at SEQ ID NO. 136
MFMDPTNPSWGWSWLERWMAARPWESRSHMDKELNDHSSIRSSSRSITGGEISKSFARFQLNSEKHSPTASQNPGSPSFQSTPSKPASSSAKKPKKVSPSPRGSWVMDEDSKSLVSVHSDRFRRHSIAGSSVRDDESLASSPAVPSYMVPTQSAKAKSRTQSPLASENAKAEKGSFGSAKKRLSFPASPARPRRHSGPPKVESSSLNAELAVDKGVDS

SEQ ID NO: 154 - protein, 445 aa, Arabidopsis thaliana
  misc_feature: Public GI ID no.7413581
  misc_feature: Score of 1020.8 for HMM of FIGURE 4.
  misc_feature: Functional Homolog Of Ceres SEEDLINE ID no. ME24091 at SEQ ID NO. 136
  misc_feature (114)..(134): Pfam Name: IQ Pfam Description: IQ calmodulin-binding motif
MGKKAKWFSSVKKAFSPDSKSKQKLAEGQNGVISNPPVVDNVRQSSSSPPPALAPREVRVAEVIVERNRDLSPPSTADAVNVTATDVPVVPSSSAPGVVRRATPTRFAGKSNEEAAAILIQTIFRGYLARRALRAMRGLVRLKLLMEGSVVKRQAANTLKCMQTLSRVQSQIRARRIRMSEENQARQKQLLQKHAKELAGLKNGDNWNDSIQSKEKVEANLLSKYEATMRRERALAYSYSHQQNWKNNSKSGNPMFMDPSNPTWVPRKNKSNSNNDNAASVKGSINRNEAAKSLTRNGSTQPNTPSSARGTPRNKNSFFSPPTPSRLNQSSRKSNDDDSKSTISVLSERNRRHSIAGSSVRDDESLAGSPALPSYMVPTKSARARLKPQSPLGGTTQENEGFTDKASAKKRLSYPTSPALPKPRRFSAPPKVESGGVTVTNGAGS

SEQ ID NO: 155 - DNA, 1806 bp, Zea mays
  misc_feature: Ceres CLONE ID no.228069
  misc_feature: Encodes the peptide sequence at SEQ ID NO 156
gagccgcggaggagcagcggcgcatcgcaacactaaccaaagtcctcctctccaggtgccgagccagggtgactgttccgaggagcgtggcgtggacccatggggaagaagggcaagtggttcggtgccgtcaagaaggtcttcagccccgaatccaaggagaagaaagaggagaggctaaggaggaaatcagcagctagcaacccagcaccggtagatctgaccccatctacctccctggaagtcaatgtttcggtgccaccccctccggctcctcctccagttcctcgccagaccgacgaggtcagggtccccgaagccgagcaggagcagagcaagcatgtcaccctggaggaggcccctgctgctgctgctgccccagcacaggcgtcggtgctgccacctggtgcgccaaccgaagagctcgccgcaatcaagatccagaccgccttccgaggttacctggcaaggagggcactaagagcactacgaggccttgtacgattgaagtcattggttgagggtaattcagttaagcgtcaatctgcaagcactctgcgctgtatgcaaactctatcgcgggtgcagtcacaaatacgatctaggagagcaaagatgtccgaggagaaccaggccctccaacgccagctcctacttaaacaggaactggagaatttcagaatgggtgagaactgggacgacagcactcaatccaaggagcaaatcgaggcaagcctaataagcaggcaagaggcagcgataagaagagaaagagctcttgcatatgcattttcacatcagtggaagagcacatcaagatctgcgaacccaatgtttgtagacccaaataacttgcagtggggctggagctggttggagcgctggatggcagcaaaaccttgggagggacgcaatgggaccgacaaggagagcaacattgatcgcggctccgtcaagaatatgagcttgaaccttggagttggagagggtgagatcacaaaagctttcaaccgccgggactcaaagccagagaagccatcaccaccgactccaaaaccggcccgtccagcttccaggcaatccccttcgacgccctctgctagagtggccccaatacctgcgaggaggaaatccagcacgccaaagaatgggctttcacaggtggacgatgacgtgaggagcgtgctcagtgtgcagtctgagcgaccaaggaggcacagcatagccacgacgtcgaccatgcgggacgatgagagcctcgcgagctccccgtcgctcccgagctacatggttcccacagaatctgcgagggccaaatctcgcacagcaacggccaatggcgcagagacgcctgagaaaggaggctctgctggaccagtcaagaagaggttgtctttccaaggtggagctgcggctgcctcaccgatgcgacggcattctggccctcccaaggtggagagcgctgtgaaggacattgctgcgccaccacagcctgaggccttggtagccaatggtggtggaagcaagtgacttgtattgacaagttccaggatgggggagcgggttatggtcttatggagggacatgtttcatccgtgaacagaagttaagagtggtgccggatctacgaatggtttgaattgttttcccgttacaaccacattgtttgctgtataagattcactgtacctgccagttggttccatttgttgttttctgtaaaacaaacatcaatttgtcactagaatctgtgatgcttgtatgtaaacaggtcctctatttatgtgagccatatatttcattttc

SEQ ID NO: 156 - protein, 476 aa, Zea mays
  misc_feature: Ceres CLONE ID no.228069
  misc_feature: Score of 953.8 for HMM of FIGURE 4.
  misc_feature: Functional Homolog Of Ceres SEEDLINE ID no. ME24091 at SEQ ID NO. 136
  misc_feature (108)..(128): Pfam Name: IQ Pfam Description: IQ calmodulin-binding motif
MGKKGKWFGAVKKVFSPESKEKKEERLRRKSAASNPAPVDLTPSTSLEVNVSVPPPPAPPPVPRQTDEVRVPEAEQEQSKHVTLEEAPAAAAAPAQASVLPPGAPTEELAAIKIQTAFRGYLARRALRALRGLVRLKSLVEGNSVKRQSASTLRCMQTLSRVQSQIRSRRAKMSEENQALQRQLLLKQELENFRMGENWDDSTQSKEQIEASLISRQEAAIRRERALAYAFSHQWKSTSRSANPMFVDPNNLQWGWSWLERWMAAKPWEGRNGTDKESNIDRGSVKNMSLNLGVGEGEITKAFNRRDSKPEKPSPPTPKPARPASRQSPSTPSARVAPIPARRKSSTPKNGLSQVDDDVRSVLSVQSERPRRHSIATTSTMRDDESLASSPSLPSYMVPTESARAKSRTATANGAETPEKGGSAGPVKKRLSFQGGAAAASPMRRHSGPPKVESAVKDIAAPPQPEALVANGGGSK

SEQ ID NO: 157 - DNA, 1703 bp, Glycine max
  misc_feature: Ceres CLONE ID no.467508
  misc_feature: Encodes the peptide sequence at SEQ ID NO 158
aaaccatcctctcttagcatttggcaagatctgatttccctcttcacaaggagagaaatagaaaggcatatgatcttcttcaagttgcaatctttttagagagagagggttagaagaacaacatacttgagatctgtcactttgtttgagttcagatcttcaaagtttccttccttgttcttttggtgcaaaggatcaaattaaggaatgccaaatggggaggaaggggaattggttttccagtgtgatgaaagctctcagtcctgactcaaaggagaagaaagaacagaaatcaagtaaatctaagaagaaatggtttgggaagcaaaaattggagacttcagtctcatactcagaagctcataaagcaccaccaccaccgcgacctattcctccaccagaagcgattaaattaactgatattgaaaatgaaatcagtcatgatcacgactatgttgttgaagttgcaactgccatggatgccgaggaacctgttccttctgttcagatagaacctgttagggttgaagctgccccaattgctcattatgctggtaaaccaaaggatgaagtggcagctatcaaaattcaaacagcttttcgtggatacttggcaagaagagcattgcgggctttaagggggctggtcaggttgaaattattgatggaagggccagttgttaaacgccaagccacaagtaccctccactctatgcagacattatctcgcttgcagtctcagattcgttcaaggaggatcagaatgttagaggagaatcaggctctgcagagacagctcttacagaagcatgcaagagagcttgagagcttgcggatgggagaggaatgggatgacagcctacaatcaaaagaacaaatcgaagccaagttacttagcaagtatgaagctactacgagaagagaaagagcgctggcttatgcattcactcatcagcaaaattggaagaactcatctagatctgtaaatccaatgttcatggatccaaccaatccaagctggggttggagctggttggaacgatggatggcagcccgaccttgggagagccgtagccatatggataaagagttgaatgaccactcatccgtaagaagctcaagccgcagtattaccggtggagaaatcagcaagtcatttgctcgtttccagctcaatttggaaaagcactctccaacagcctgccagaatcctggctcacctagctttcagtccactccttccaagccagcttcaatatctgctaagaaaccaaagaaggtaagtccaagcccaaggggcagctgggttacagacgaggactccaaaagcttggtcagtgtacagtcagaccggttccggaggcactccattgccggttcattggtgagagatgatgagagccttgctagctctccagcagttccaagctacatggtgccaactcaatctgcaaaagccaagtccaggacacaaagtccattagccccagaaaatggaaaagcagagaaaggttcctttgggagtgcgaagaagcggctttctttcccagcttcacctgccaggccaaggcgccattcaggtccaccaaaggtagaaagcagcagcttaaatgcagagttagctgtggacaagggtgtggacagttgatcatacaagtaaaaggatggaaaaacattaaagtaggattgaaaatatatcactg

SEQ ID NO: 158 - protein, 477 aa, Glycine max
  misc_feature: Ceres CLONE ID no.467508
  misc_feature: Score of 852.8 for HMM of FIGURE 4.
  misc_feature: Functional Homolog Of Ceres SEEDLINE ID no. ME24091 at SEQ ID NO. 136
  misc_feature (119)..(139): Pfam Name: IQ Pfam Description: IQ calmodulin-binding motif
MGRKGNWFSSVMKALSPDSKEKKEQKSSKSKKKWFGKQKLETSVSYSEAHKAPPPPRPIPPPEAIKLTDIENEISHDHDYVVEVATAMDAEEPVPSVQIEPVRVEAAPIAHYAGKPKDEVAAIKIQTAFRGYLARRALRALRGLVRLKLLMEGPVVKRQATSTLHSMQTLSRLQSQIRSRRIRMLEENQALQRQLLQKHARELESLRMGEEWDDSLQSKEQIEAKLLSKYEATTRRERALAYAFTHQQNWKNSSRSVNPMFMDPTNPSWGWSWLERWMAARPWESRSHMDKELNDHSSVRSSSRSITGGEISKSFARFQLNLEKHSPTACQNPGSPSFQSTPSKPASISAKKPKKVSPSPRGSWVTDEDSKSLVSVQSDRFRRHSIAGSLVRDDESLASSPAVPSYMVPTQSAKAKSRTQSPLAPENGKAEKGSFGSAKKRLSFPASPARPRRHSGPPKVESSSLNAELAVDKGVDS

SEQ ID NO: 159 - DNA, 1495 bp, Gossypium hirsutum
  misc_feature: Ceres CLONE ID no.1829581
  misc_feature: Encodes the peptide sequence at SEQ ID NO 160
attattttcaatgcaatttaagagttttatttattttatgttataaattttttaacctctaaatatgatttgaaatgttaattccattggttgtttttggttttgaaggagaatttattgaggaatgggcaaaaaaggaagctggtttactgctgtgaagaaagttctaagccttgaacccaacaaagaagagaagattcaaaaatccaagaaaaatggggttaaattacctgagaagatcaaaggaagcaaacgtgacaactggttcgctccggccaccaccatggtgaccggcgcgttggttcgccttactttgtcgccacactacttgggaaaatcaatggaggaaatagctactgttaagattcaaactgtgtttcgaggatacctggcgaggaaggcattgcgagatttgagagggttagagaggttgaaatcattgatacaagggcaatccatgaaacgacaagccactattacgttacgatgcatgcggacacttgctcgagtgcagtcccaaactcgaacaaggcaactcagagtgtctgaacaaaaccgagcacttcaaaagcatcttcaaactaaatacgaaaaacagttgcaaaattccaaatcttacatgggagaagattggaatgtaagtactaagtctaaagagcaaatgcaagcaaaacaacaatatagacaagtagcagccatgcgaagggagagagctttagcttactcatttactcatcagcgatcctggaaggtcacttgtagatcgatgaatcacacatctatggatccatttaatcctaaatggagctggagttggttagagcgatggatgtcaactcgaccatgggagattcaaaatgcaccggataacaatgatcatggcccaagtaagagtgttggtgctgagataaccaaagctaagtctcaaagtgatgttaacaatgatcacaataaacaatcttcaacaccggcaaaaccgattcgacctccgaaccgtaggtcctcttcgactccaccgtctaaaacgcattctatttctagcaagaagggattggaaagccccagtccgacacgaattcagttgcctgattgttacaagaggcatagcatcggaggcttatcattggagagagacgatgaggtctttgcaaactcaccacctaataataaaataccggcacgttcgtcatcaaaggaccggtctcgaccaccgagcattaatagaaatccagttaatactaggagacattctggtcctccgaaagttgatattttttccaactaaggaagaaatgccaaacaatgacaaaggcaggtagtttatgaagcatagacactttagtcgcgagtgccggccacatgtttaatattgaaatggctccgacacaatcaaatgtgtgttggttatatgacgatatattttttcaaaaaatcaaatactatcagaaaaaaatataaagaaagattaattggataaaaaaaaaaaaaaaaaaaa

SEQ ID NO: 160 - protein, 386 aa, Gossypium hirsutum
  misc_feature: Ceres CLONE ID no.1829581
  misc_feature: Score of 365.8 for HMM of FIGURE 4.
  misc_feature: Functional Homolog Of Ceres SEEDLINE ID no. ME24091 at SEQ ID NO. 136
  misc_feature (75)..(95): Pfam Name: IQ Pfam Description: IQ calmodulin-binding motif
MGKKGSWFTAVKKVLSLEPNKEEKIQKSKKNGVKLPEKIKGSKRDNWFAPATTMVTGALVRLTLSPHYLGKSMEEIATVKIQTVFRGYLARKALRDLRGLERLKSLIQGQSMKRQATITLRCMRTLARVQSQTRTRQLRVSEQNRALQKHLQTKYEKQLQNSKSYMGEDWNVSTKSKEQMQAKQQYRQVAAMRRERALAYSFTHQRSWKVTCRSMNHTSMDPFNPKWSWSWLERWMSTRPWEIQNAPDNNDHGPSKSVGAEITKAKSQSDVNNDHNKQSSTPAKPIRPPNRRSSSTPPSKTHSISSKKGLESPSPTRIQLPDCYKRHSIGGLSLERDDEVFANSPPNNKIPARSSSKDRSRPPSINRNPVNTRRHSGPPKVDIFSN

SEQ ID NO: 161 - DNA, 1543 bp, Zea mays
  misc_feature: Ceres CLONE ID no.229668
  misc_feature: Encodes the peptide sequence at SEQ ID NO 162
cttggaagtcaatctttcggtgccaccgcctccagctcctcccccagttcttcaccaggccgaggaggttggggtccctgaagccgagcaggagcagagcaagcatgtcgccgtggaggaggcccctgctgccgccccagcgcaggcgtcggtgctgccacctgctgtgccaacccaagagctcgccgcagtcaagatccagaccgccttccgaggttacctggcaaggagggcactacgagcactgcgaggccttgttcgattgaagtcattggttgagggtaattcagtaaagcgtcaatctgcaagcactctgcgctgcatgcaaactctatcacgggtgcagtcacagatatcttccaggagagcaaagatgtccgaggagaaccaggctctccaacgccagctcctacttaaacaggaactggagaatttcagaatgggtgagaactgggatgacagcacccaatccaaggagcaaatcgaggcaagcctgataagcaggcaagaggcggcgataagaagagaaagagcgcttgcatatgcattttcacaccagtggaagagtacatcgagatctgtcaacccaatgtttgtagacccaaacaacctgcagtggggctggagctggctggagcgctggatggcagcaaaaccatgggaaggccgcaatggggctgacaaggagagcaacattgaccggggatccgttaagagcatgagcttgaaccttggagagggtgagatcacaaaagctttcaaccgccgggactcaaagctagaaaagccatcgccgccaactccaagaccggcccgtccaacttccaggcattcccctttgacgccctctgctagagtggcaccgatacctgcgaggagaaaatctgtcacgcccaagaacgggctttcacaggtggacgatgacgcgaggagcgtgctcagtgtgcagtctgagcggccaaggaggcacagtatagccacctcgactgtgcgggacgacgagagcctcacgagctccccgtcgctcccaagctacatggttcccacagaatctgcaagggccaaatctcgcctccagggttcagcaatggccaatggcgcagagacacctgagaaaggaggctcaactggaccagccaagaagaggttatccttccagggtggaactgcggctgcctcgccaatgcgacgacattctggtcctcccaaggtggagatcgcgccaccacaaccagaggccttggtagtcaatggtggaagcaagtgacacatatgtgatgagtaccaggatgagaaacggattatgaagatattagtttcattttcatccatgaatagaagttaaaagtggtatcatatctatgaatggtttcaattgtttttctgttacaaccacattatttgctatatacgattcacagtacctgccagttgattccattggttgtttctgtaaaacaaatatcaatttgtcactagaatctgtgatgtttgtatgtaaacagatcctctatttatgtgagacatatatttcttttctttc

SEQ ID NO: 162 - protein, 421 aa, Zea mays; identical to SEQ ID NO: 143
  misc_feature: Ceres CLONE ID no.229668
  misc_feature: Score of 908.3 for HMM of FIGURE 4.
  misc_feature: Functional Homolog Of Ceres SEEDLINE ID no. ME24091 at SEQ ID NO. 136
  misc_feature (60)..(80): Pfam Name: IQ Pfam Description: IQ calmodulin-binding motif

SEQ ID NO: 163 - protein, 500 aa, Oryza sativa subsp. indica
  misc_feature: Public GI ID no.125550655
  misc_feature: Score of 911.0 for HMM of FIGURE 4.
  misc_feature: Functional Homolog Of Ceres SEEDLINE ID no. ME24091 at SEQ ID NO. 136
  misc_feature (107)..(121): Pfam Name: IQ Pfam Description: IQ calmodulin-binding motif
MGKKGKWFGAVKKVFSPESKEKKEERLRRKLAASNPNPPDLTPSASLEVNVSVPPPPPPPPVQQIEEVKVPEVEQEQSKHVTVEAVPEAVPVPAQTSSLPPGVSREEQAAIKIQTAFRGYLLSENSSWLFISSAAFIYHCVGANITKARRALRALRGLVRLKSLVEGNSVKRQAASTLRCMQTLARVQSQIRSRRLKMSEENQALQRQLLLKQELESLRMGEQWDDSTQSKEQIEASLISRQEAAVRRERALAYAFSHQWKSTSRSVNPMFVDPNNPQWGWSWLERWMAAKPWEGRAGTDKESNLDRASAKSASLNLGEGEITKAFNRRGSKPDKSSPTTPKLTRPASRQSPSTPSAKVSPIFAKKKSATPKNGLSQVDDDAKSVFSVQSERPRRHSIATSTVRDDESLASSPSVPSYMAPTKSARAKLRLQGSAVTDGAETPPEKVASVGSVKKKLSFQAGMVPPSPMRRHSGPPKVEVVKDIAEPPQPEALVINGGSK

SEQ ID NO: 164 - DNA, 1923 bp, Arabidopsis thaliana; identical to SEQ ID NO: 135
  misc_feature: Ceres CLONE ID no.106263
  misc_feature: Encodes the peptide sequence at SEQ ID NO 165

SEQ ID NO: 165 - protein, 461 aa, Arabidopsis thaliana; identical to SEQ ID NO: 136
  misc_feature: Ceres CLONE ID no.106263
  misc_feature: Score of 1104.8 for HMM of FIGURE 4.
  misc_feature: Functional Homolog Of Ceres SEEDLINE ID no. ME24091 at SEQ ID NO. 136
  misc_feature (88)..(88): Xaa is any aa, unknown, or other
  misc_feature (115)..(135): Pfam Name: IQ Pfam Description: IQ calmodulin-binding motif
  misc_feature (180)..(180): Xaa is any aa, unknown, or other
  misc_feature (243)..(243): Xaa is any aa, unknown, or other
  misc_feature (370)..(370): Xaa is any aa, unknown, or other
  misc_feature (377)..(377): Xaa is any aa, unknown, or other

SEQ ID NO: 166 - protein, 430 aa, Arabidopsis thaliana
  misc_feature: Public GI ID no.15231175
  misc_feature: Score of 592.8 for HMM of FIGURE 4.
  misc_feature: Functional Homolog Of Ceres SEEDLINE ID no. ME24091 at SEQ ID NO. 136
  misc_feature (108)..(128): Pfam Name: IQ Pfam Description: IQ calmodulin-binding motif
MGKSWFSAVKKALSPEPKQKKEQKPHKSKKWFGKSKKLDVTNSGAAYSPRTVKDAKLKEIEEQQSRHAYSVAIATAAAAEAAVAAAQAAAEVVRLSALSRFPGKSMEEIAAIKIQTAFRGYMARRALRALRGLVRLKSLVQGKCVRRQATSTLQSMQTLARVQYQIRERRLRLSEDKQALTRQLQQKHNKDFDKTGENWNDSTLSREKVEANMLNKQVATMRREKALAYAFSHQNTWKNSTKMGSQTFMDPNNPHWGWSWLERWMAARPNENHSLTPDNAEKDSSARSVASRAMSEMIPRGKNLSPRGKTPNSRRGSSPRVRQVPSEDSNSIVSFQSEQPCNRRHSTCGSIPSTRDDESFTSSFSQSVPGYMAPTQAAKARARFSNLSPLSSEKTAKKRLSFSGSPKTVRRFSGPPKLESNVTKKDTNLA

SEQ ID NO: 167 - protein, 461 aa, Arabidopsis thaliana
  misc_feature: Public GI ID no.145357576
  misc_feature: Score of 1118.9 for HMM of FIGURE 4.
  misc_feature: Functional Homolog Of Ceres SEEDLINE ID no. ME24091 at SEQ ID NO. 136
  misc_feature (115)..(135): Pfam Name: IQ Pfam Description: IQ calmodulin-binding motif
MGKKAKWFSSVKKAFSPDSKKSKQKLAEGQNGVISNPPVVDNVRQSSSSPPPALAPREVRVAEVIVERNRDLSPPSTADAVNVTATDVPVVPSSSAPGVVRRATPTRFAGKSNEEAAAILIQTIFRGYLARRALRAMRGLVRLKLLMEGSVVKRQAANTLKCMQTLSRVQSQIRARRIRMSEENQARQKQLLQKHAKELAGLKNGDNWNDSIQSKEKVEANLLSKYEATMRRERALAYSYSHQQNWKNNSKSGNPMFMDPSNPTWGWSWLERWMAGRPLESSEKEQSNSNNDNAASVKGSINRNEAAKSLTRNGSTQPNTPSSARGTPRNKNSFFSPPTPSRLNQSSRKSNDDDSKSTISVLSERNRRHSIAGSSVRDDESLAGSPALPSYMVPTKSARARLKPQSPLGGTTQENEGFTDKASAKKRLSYPTSPALPKPRRFSAPPKVESGGVTVTNGAGS

SEQ ID NO: 168 - protein, 474 aa, Oryza sativa subsp. indica
  misc_feature: Public GI ID no.125528277
  misc_feature: Score of 1169.9 for HMM of FIGURE 4.
  misc_feature: Functional Homolog Of Ceres SEEDLINE ID no. ME24091 at SEQ ID NO. 136
  misc_feature (142)..(162): Pfam Name: IQ Pfam Description: IQ calmodulin-binding motif
MGKKGNWFSAVKKVFSSSDPDGREAKIEKADKSRSRRKWPFGKSKKSDPWTSTVAVPTSTAPPPQPPPPPPTHPIQPQPEEIKDVKAVETDSEQNKHAYSVALASAVAAEAAAVAAQAAAEVVRLTTATTAVPKSPVSSKDELAAIKIQTAFRGYLARRALRALRGLVRLKSLVDGNAVKRQTAHTLHCTQTMTRVQTQIYSRRVKMEEEKQALQRQLQLKHQRELEKMKIDEDWDHSHQSKEQWKNSGRTITPTFTDQGNPNWGWSWMERWMTSRPWESRVISDKDPKDHYSTKNPSTSASRTYVPRAISIQRPATPNKSSRPPSRQSPSTPPSRVPSVTGKIRPASPRDSWLYKEDDLRSITSIRSERPRRQSTGGASVRDDASLTSTPALPSYMQSTESARAKSRYRSLLTDRFEVPERVPLVHSSIKKRLSFPVADKPNGEHADKLMERGRRHSDPPKVDPASLKDVPVS

The invention claimed is:

1. A method of producing a plant having increased tolerance to salinity or increased tolerance to oxidative stress, said method comprising growing a plant cell transformed with an exogenous nucleic acid, said exogenous nucleic acid comprising a heterologous promoter operably linked to a nucleotide sequence encoding a polypeptide having 95% or greater amino acid sequence identity to the amino acid sequence of SEQ ID NO: 140 and wherein said transformed plant has an increase in the level of tolerance to salinity or oxidative stress as compared to a control plant of the same species cultivated under the same conditions that does not comprise said nucleic acid.

2. The method according to claim 1, wherein said polypeptide comprises the amino acid sequence of SEQ ID NO: 140.

3. A plant cell transformed with an exogenous nucleic acid, wherein said exogenous nucleic acid comprises a heterologous promoter operably linked to a nucleotide molecule comprising a nucleotide sequence encoding a polypeptide having 95 percent or greater sequence identity to the amino acid sequence of SEQ ID NO: 140, wherein a plant produced from said plant cell expresses said polypeptide and has an increase in the level of tolerance to salinity or oxidative stress as compared to a control plant of the same species cultivated under the same conditions that does not comprise said nucleic acid.

4. A plant cell transformed with an exogenous nucleic acid, wherein said exogenous nucleic acid comprises a heterologous promoter operably linked to a nucleotide molecule comprising a nucleotide sequence encoding a polypeptide having 97 percent or greater sequence identity to the amino acid sequence of SEQ ID NO: 140, wherein a plant produced from said plant cell expresses said polypeptide and has an increase in the level of tolerance to salinity or oxidative stress as compared to a control plant of the same species cultivated under the same conditions that does not comprise said nucleic acid.

5. A transgenic plant comprising the plant cell of claim 3.

6. The transgenic plant of claim 5, wherein said plant is a member of a species selected from the group consisting of *Panicum virgatum* (switchgrass), *Sorghum bicolor* (sorghum, sudangrass), *Miscanthus giganteus* (miscanthus), *Saccharum* sp. (energycane), *Populus balsamifera* (poplar), *Zea mays* (corn), *Glycine max* (soybean), *Brassica napus* (canola), *Triticum aestivum* (wheat), *Gossypium hirsutum* (cotton), *Oryza* sativa (rice), *Helianthus annuus* (sunflower), *Medicago* saliva (alfalfa), *Beta vulgaris* (sugarbeet), and *Pennisetum glaucum* (pearl millet).

7. A seed or vegetative tissue comprising the plant cell according to claim 3.

* * * * *